United States Patent 11,413,346 (ROTAVIRUS VACCINES) - sequence listing, part 2

SEQ ID NO: 3085 - RNA, 928 nt, Artificial Sequence
  VP8* aa64-223short P[6] P2+Linker w/o glyco mRNA opt Design2
ggggcgcugccuacggagguggcagccaucuccuucucggcaucaagcuuaccaugcaguacaucaaggccaacagcaaguucaucggcaucaccgagcugggcagcggguccggcguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3086 - RNA, 928 nt, Artificial Sequence
  VP8* aa64-223short P[4] SP(TPA) w/o glyco mRNA opt Design2
ggggcgcugccuacggagguggcagccaucuccuucucggcaucaagcuuaccauggacgccaugaagcgcggccugugcugcgugcuccugcugugcggggccgucuucgugagcgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3087 - RNA, 928 nt, Artificial Sequence
  VP8* aa64-223short P[6] SP(TPA) w/o glyco mRNA opt Design2
ggggcgcugccuacggagguggcagccaucuccuucucggcaucaagcuuaccauggacgccaugaagcgcggccugugcugcgugcuccugcugugcggggccgucuucgugagcguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3088 - RNA, 919 nt, Artificial Sequence
  VP8* aa64-223short P[4] SP(HSA) w/o glyco mRNA opt Design2
ggggcgcugccuacggagguggcagccaucuccuucucggcaucaagcuuaccaugaagugggugaccuucaucagccugcucuuccuguucuccagcgccuacuccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3089 - RNA, 919 nt, Artificial Sequence
  VP8* aa64-223short P[6] SP(HSA) w/o glyco mRNA opt Design2
ggggcgcugccuacggagguggcagccaucuccuucucggcaucaagcuuaccaugaagugggugaccuucaucagccugcucuuccuguucuccagcgccuacuccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3090 - RNA, 919 nt, Artificial Sequence
  VP8* aa64-223short P[4] SP(IgE) w/o glyco mRNA opt Design2
ggggcgcugccuacggagguggcagccaucuccuucucggcaucaagcuuaccauggacuggaccuggauccuguuccucguggccgccgcgacccgcguccacagcgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3091 - RNA, 919 nt, Artificial Sequence
  VP8* aa64-223short P[6] SP(IgE) w/o glyco mRNA opt Design2
ggggcgcugccuacggagguggcagccaucuccuucucggcaucaagcuuaccauggacuggaccuggauccuguuccucguggccgccgcgacccgcguccacagcguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3092 - RNA, 937 nt, Artificial Sequence
  VP8* aa64-223short P[4] SP(CD5) w/o glyco mRNA opt Design2
ggggcgcugccuacggagguggcagccaucuccuucucggcaucaagcuuaccaugcccaugggcagccugcagccgcucgccacccuguaccugcucgggaugcugguggccuccugccugggcgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3093 - RNA, 937 nt, Artificial Sequence
  VP8* aa64-223short P[6] SP(CD5) w/o glyco mRNA opt Design2
ggggcgcugccuacggagguggcagccaucuccuucucggcaucaagcuuaccaugcccaugggcagccugcagccgcucgccacccuguaccugcucgggaugcugguggccuccugccugggcguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3094 - RNA, 937 nt, Artificial Sequence
  VP8* aa64-223short P[4] SP(HLA-A2) w/o glyco mRNA opt Design2
ggggcgcugccuacggagguggcagccaucuccuucucggcaucaagcuuaccauggccgugauggccccgcggacccugguccuccugcugagcggcgcgcucgcccugacccagacgugggccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3095 - RNA, 937 nt, Artificial Sequence
  VP8* aa64-223short P[6] SP(HLA-A2) w/o glyco mRNA opt Design2
ggggcgcugccuacggagguggcagccaucuccuucucggcaucaagcuuaccauggccgugauggccccgcggacccugguccuccugcugagcggcgcgcucgcccugacccagacgugggccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3096 - RNA, 988 nt, Artificial Sequence
  VP8* aa64-223short P[4] SP(TPA)+P2+Linker w/o glyco mRNA opt Design2
ggggcgcugccuacggagguggcagccaucuccuucucggcaucaagcuuaccauggacgccaugaagcgcggccugugcugcgugcuccugcugugcggggccgucuucgugagccaguacaucaaggccaacagcaaguucaucggcaucaccgagcugggcagcggguccggcgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3097 - RNA, 988 nt, Artificial Sequence
  VP8* aa64-223short P[6] SP(TPA)+P2+Linker w/o glyco mRNA opt Design2
ggggcgcugccuacggagguggcagccaucuccuucucggcaucaagcuuaccauggacgccaugaagcgcggccugugcugcgugcuccugcugugcggggccgucuucgugagccaguacaucaaggccaacagcaaguucaucggcaucaccgagcugggcagcggguccggcguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3098 - RNA, 979 nt, Artificial Sequence
  VP8* aa64-223short P[4] SP(HSA)+P2+Linker w/o glyco mRNA opt Design2
ggggcgcugccuacggagguggcagccaucuccuucucggcaucaagcuuaccaugaagugggugaccuucaucagccugcucuuccuguucuccagcgccuacucccaguacaucaaggccaacagcaaguucaucggcaucaccgagcugggcagcggguccggcgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3099 - RNA, 979 nt, Artificial Sequence
  VP8* aa64-223short P[6] SP(HSA)+P2+Linker w/o glyco mRNA opt Design2
ggggcgcugccuacggagguggcagccaucuccuucucggcaucaagcuuaccaugaagugggugaccuucaucagccugcucuuccuguucuccagcgccuacucccaguacaucaaggccaacagcaaguucaucggcaucaccgagcugggcagcggguccggcguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3100 - RNA, 979 nt, Artificial Sequence
  VP8* aa64-223short P[4] SP(IgE)+P2+Linker w/o glyco mRNA opt Design2
ggggcgcugccuacggagguggcagccaucuccuucucggcaucaagcuuaccauggacuggaccuggauccuguuccucguggccgccgcgacccgcguccacagccaguacaucaaggccaacagcaaguucaucggcaucaccgagcugggcagcggguccggcgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3101 - RNA, 979 nt, Artificial Sequence
  VP8* aa64-223short P[6] SP(IgE)+P2+Linker w/o glyco mRNA opt Design2
ggggcgcugccuacggagguggcagccaucuccuucucggcaucaagcuuaccauggacuggaccuggauccuguuccucguggccgccgcgacccgcguccacagccaguacaucaaggccaacagcaaguucaucggcaucaccgagcugggcagcggguccggcguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3102 - RNA, 997 nt, Artificial Sequence
  VP8* aa64-223short P[4] SP(CD5)+P2+Linker w/o glyco mRNA opt Design2
ggggcgcugccuacggagguggcagccaucuccuucucggcaucaagcuuaccaugcccaugggcagccugcagccgcucgccacccuguaccugcucgggaugcugguggccuccugccugggccaguacaucaaggccaacagcaaguucaucggcaucaccgagcugggcagcggguccggcgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3103 - RNA, 997 nt, Artificial Sequence
  VP8* aa64-223short P[6] SP(CD5)+P2+Linker w/o glyco mRNA opt Design2
ggggcgcugccuacggagguggcagccaucuccuucucggcaucaagcuuaccaugcccaugggcagccugcagccgcucgccacccuguaccugcucgggaugcugguggccuccugccugggccaguacaucaaggccaacagcaaguucaucggcaucaccgagcugggcagcggguccggcguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3104 - RNA, 997 nt, Artificial Sequence
  VP8* aa64-223short P[4] SP(HLA-A2)+P2+Linker w/o glyco mRNA opt Design2
ggggcgcugccuacggagguggcagccaucuccuucucggcaucaagcuuaccauggccgugauggccccgcggacccugguccuccugcugagcggcgcgcucgcccugacccagacgugggcccaguacaucaaggccaacagcaaguucaucggcaucaccgagcugggcagcggguccggcgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagcaguccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaaccaggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3105 - RNA, 997 nt, Artificial Sequence
  VP8* aa64-223short P[6] SP(HLA-A2)+P2+Linker w/o glyco mRNA opt Design2
ggggcgcugccuacggagguggcagccaucuccuucucggcaucaagcuuaccauggccgugauggccccgcggacccugguccuccugcugagcggcgcgcucgcccugacccagacgugggcccaguacaucaaggccaacagcaaguucaucggcaucaccgagcugggcagcggguccggcguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3106 - RNA, 1150 nt, Artificial Sequence
  P2 VP8* P[4]-long mRNA opt Design2
ggggcgcugccuacggagguggcagccaucuccuucucggcaucaagcuuaccaugcaguacaucaaggccaacagcaaguucaucggcaucaccgagcuggccagccugaucuaccgccagcuccugaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3107 - RNA, 1150 nt, Artificial Sequence
  P2 VP8* P[6]-long mRNA opt Design2
ggggcgcugccuacggagguggcagccaucuccuucucggcaucaagcuuaccaugcaguacaucaaggccaacagcaaguucaucggcaucaccgagcuggccagccugaucuaccgccagcuccugaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3108 - RNA, 1150 nt, Artificial Sequence
  P2 VP8* P[8]-long mRNA opt Design2
ggggcgcugccuacggagguggcagccaucuccuucucggcaucaagcuuaccaugcaguacaucaaggccaacagcaaguucaucggcaucaccgagcuggccagccugaucuaccgccagcuccugaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3109 - RNA, 913 nt, Artificial Sequence
  P2 VP8* P[4]-short mRNA opt Design2
ggggcgcugccuacggagguggcagccaucuccuucucggcaucaagcuuaccaugcaguacaucaaggccaacagcaaguucaucggcaucaccgagcuggugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3110 - RNA, 913 nt, Artificial Sequence
  P2 VP8* P[6]-short mRNA opt Design2
ggggcgcugccuacggagguggcagccaucuccuucucggcaucaagcuuaccaugcaguacaucaaggccaacagcaaguucaucggcaucaccgagcugguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3111 - RNA, 910 nt, Artificial Sequence
  P2 VP8* P[8]-short mRNA opt Design2
ggggcgcugccuacggagguggcagccaucuccuucucggcaucaagcuuaccaugcaguacaucaaggccaacagcaaguucaucggcaucaccgagcugcucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3112 - RNA, 910 nt, Artificial Sequence
  R4509/R4510 P2 VP8* P[8]-WA-VirWa-short mRNA opt Design2
ggggcgcugccuacggagguggcagccaucuccuucucggcaucaagcuuaccaugcaguacaucaaggccaacagcaaguucaucggcaucaccgagcugcucgacgggcccuaccagccgacgaccuucaccccgcccaacgacuacuggauccugaucaacagcaacaccaacggcgucguguacgaguccacgaacaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaacaacaucagcaucaccauccacuccgaguucuacaucaucccccgcagccaggagagcaagugcaacgaguacaucaacaacgggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3113 - RNA, 1210 nt, Artificial Sequence
  SP P2 VP8* P[4]-long w/o glyco mRNA opt Design2
ggggcgcugccuacggagguggcagccaucuccuucucggcaucaagcuuaccauggacgccaugaagcgcggccugugcugcgugcuccugcugugcggggccgucuucgugagccaguacaucaaggccaacagcaaguucaucggcaucaccgagcuggccagccugaucuaccgccagcuccugaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaacaacgggcugccgcccauccagaacacccggaacguggugccgcucagccuguccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3114 - RNA, 1210 nt, Artificial Sequence
  SP P2 VP8* P[6]-long w/o glyco mRNA opt Design2
ggggcgcugccuacggagguggcagccaucuccuucucggcaucaagcuuaccauggacgccaugaagcgcggccugugcugcgugcuccugcugugcggggccgucuucgugagccaguacaucaaggccaacagcaaguucaucggcaucaccgagcuggccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3115 - RNA, 1210 nt, Artificial Sequence
  SP P2 VP8* P[8]-long w/o glyco mRNA opt Design2
ggggcgcugccuacggagguggcagccaucuccuucucggcaucaagcuuaccauggacgccaugaagcgcggccugugcugcgugcuccugcugugcggggccgucuucgugagccaguacaucaaggccaacagcaaguucaucggcaucaccgagcuggccagccugaucuaccgccagcuccugaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacaccaacggggugguguacgagagcacccagaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3116 - RNA, 973 nt, Artificial Sequence
  SP P2 VP8* P[4]-short w/o glyco mRNA opt Design2
ggggcgcugccuacggagguggcagccaucuccuucucggcaucaagcuuaccauggacgccaugaagcgcggccugugcugcgugcuccugcugugcggggccgucuucgugagccaguacaucaaggccaacagcaaguucaucggcaucaccgagcuggugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaacaacgggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3117 - RNA, 973 nt, Artificial Sequence
  SP P2 VP8* P[6]-short w/o glyco mRNA opt Design2
ggggcgcugccuacggagguggcagccaucuccuucucggcaucaagcuuaccauggacgccaugaagcgcggccugugcugcgugcuccugcugugcggggccgucuucgugagccaguacaucaaggccaacagcaaguucaucggcaucaccgagcugguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3118 - RNA, 970 nt, Artificial Sequence
  SP P2 VP8* P[8]-short w/o glyco mRNA opt Design2
ggggcgcugccuacggagguggcagccaucuccuucucggcaucaagcuuaccauggacgccaugaagcgcggccugugcugcgugcuccugcugugcggggccgucuucgugagccaguacaucaaggccaacagcaaguucaucggcaucaccgagcugcucgacggcccguaccagccgacgaccuucaccccgcccaccgacuacuggauccugaucacguccaacaccaacggggugguguacgagagcacccagaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3119 - RNA, 970 nt, Artificial Sequence
  R4511/R4512 SP P2 VP8* P[8]-WA-VirWa-short w/o glyco mRNA opt Design2
ggggcgcugccuacggagguggcagccaucuccuucucggcaucaagcuuaccauggacgccaugaagcgcggccugugcugcgugcuccugcugugcggggccgucuucgugagccaguacaucaaggccaacagcaaguucaucggcaucaccgagcugcucgacgggcccuaccagccgacgaccuucaccccgcccaacgacuacuggauccugaucaacagcaacaccaacggcgucguguacgaguccacgcagaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaacaacgggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3120 - RNA, 1348 nt, Artificial Sequence
  R3711/R3712 SP P2 VP8* P[4]-long w/o glyco w TM domain mRNA opt Design2
ggggcgcugccuacggagguggcagccaucuccuucucggcaucaagcuuaccauggacgccaugaagcgcggccugugcugcgugcuccugcugugcggggccgucuucgugagccaguacaucaaggccaacagcaaguucaucggcaucaccgagcuggccagccugaucuaccgccagcuccugaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaacaacgggcugccgcccauccagaacacccggaacguggugccgcucagccuguccagccgcaagcucgaguccacgcggaucuaccagauccuggcgaucuacagcaccgucgccagcucccuggugcucguggucagccugggggccaucuccuucuggaugugcagcaacggcucccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3121 - RNA, 1348 nt, Artificial Sequence
  R3721/R3722 SP P2 VP8* P[6]-long w/o glyco w TM domain mRNA opt Design2
ggggcgcugccuacggagguggcagccaucuccuucucggcaucaagcuuaccauggacgccaugaagcgcggccugugcugcgugcuccugcugugcggggccgucuucgugagccaguacaucaaggccaacagcaaguucaucggcaucaccgagcuggccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcaagcucgaguccacgcggaucuaccagauccuggcgaucuacagcaccgucgccagcucccuggugcucguggucagccugggggccaucuccuucuggaugugcagcaacggcucccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3122 - RNA, 1348 nt, Artificial Sequence
  R3691/R3692 SP P2 VP8* P[8]-long w/o glyco w TM domain mRNA opt Design2
ggggcgcugccuacggagguggcagccaucuccuucucggcaucaagcuuaccauggacgccaugaagcgcggccugugcugcgugcuccugcugugcggggccgucuucgugagccaguacaucaaggccaacagcaaguucaucggcaucaccgagcuggccagccugaucuaccgccagcuccugaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacaccaacggggugguguacgagagcacccagaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcaagcucgaguccacgcggaucuaccagauccuggcgaucuacagcaccgucgccagcucccuggugcucguggucagccugggggccaucuccuucuggaugugcagcaacggcucccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3123 - RNA, 1111 nt, Artificial Sequence
  SP P2 VP8* P[4]-short w/o glyco w TM domain mRNA opt Design2
ggggcgcugccuacggagguggcagccaucuccuucucggcaucaagcuuaccauggacgccaugaagcgcggccugugcugcgugcuccugcugugcggggccgucuucgugagccaguacaucaaggccaacagcaaguucaucggcaucaccgagcuggugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaacaacgggcugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3124 - RNA, 1111 nt, Artificial Sequence
  SP P2 VP8* P[6]-short w/o glyco w TM domain mRNA opt Design2
ggggcgcugccuacggagguggcagccaucuccuucucggcaucaagcuuaccauggacgccaugaagcgcggccugugcugcgugcuccugcugugcggggccgucuucgugagccaguacaucaaggccaacagcaaguucaucggcaucaccgagcugguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3125 - RNA, 1108 nt, Artificial Sequence
  SP P2 VP8* P[8]-short w/o glyco w TM domain mRNA opt Design2
ggggcgcugccuacggagguggcagccaucuccuucucggcaucaagcuuaccauggacgccaugaagcgcggccugugcugcgugcuccugcugugcggggccgucuucgugagccaguacaucaaggccaacagcaaguucaucggcaucaccgagcugcucgacggcccguaccagccgacgaccuucaccccgcccaccgacuacuggauccugaucacguccaacaccaacggggugguguacgagagcacccagaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3126 - RNA, 1108 nt, Artificial Sequence
  SP P2 VP8* P[8]-WA-VirWa-short w/o glyco w TM domain mRNA opt Design2
ggggcgcugccuacggagguggcagccaucuccuucucggcaucaagcuuaccauggacgccaugaagcgcggccugugcugcgugcuccugcugugcggggccgucuucgugagccaguacaucaaggccaacagcaaguucaucggcaucaccgagcugcucgacgggcccuaccagccgacgaccuucaccccgcccaacgacuacuggauccugaucaacagcaacaccaacggcgucguguacgaguccacgcagaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaacaacgggcugaagcucgaguccacgcggaucuaccagauccuggcgaucuacagcaccgucgccagcucccuggugcucguggucagccugggggccaucuccuucuggaugugcagcaacggcucccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3127 - RNA, 1684 nt, Artificial Sequence
  R3713/R3714 SP VLP peptide linker P2 VP8* P[4]-long w/o glyco mRNA opt Design2
ggggcgcugccuacggagguggcagccaucuccuucucggcaucaagcuuaccauggacgccaugaagcgcggccugugcugcgugcuccugcugugcggggccgucuucgugagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcaggugcgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcggcgggggcgggagcggcgggggcggccaguacaucaaggccaacagcaaguucaucggcaucaccgagcuggccagccugaucuaccgccagcuccugaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaacaacgggcugccgcccauccagaacacccggaacguggugccgcucagccuguccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3128 - RNA, 1684 nt, Artificial Sequence
  R3723/R3724 SP VLP peptide linker P2 VP8* P[6]-long w/o glyco mRNA opt Design2
ggggcgcugccuacggagguggcagccaucuccuucucggcaucaagcuuaccauggacgccaugaagcgcggccugugcugcgugcuccugcugugcggggccgucuucgugagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcaggugcgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcggcgggggcgggagcggcgggggcggccaguacaucaaggccaacagcaaguucaucggcaucaccgagcuggccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3129 - RNA, 1684 nt, Artificial Sequence
  R3693/R3694 SP VLP peptide linker P2 VP8* P[8]-long w/o glyco mRNA opt Design2
ggggcgcugccuacggagguggcagccaucuccuucucggcaucaagcuuaccauggacgccaugaagcgcggccugugcugcgugcuccugcugugcggggccgucuucgugagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcaggugcgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcggcgggggcgggagcggcgggggcggccaguacaucaaggccaacagcaaguucaucggcaucaccgagcuggccagccugaucuaccgccagcuccugaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacaccaacggggugguguacgagagcacccagaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3130 - RNA, 1447 nt, Artificial Sequence
  SP VLP peptide linker P2 VP8* P[4]-short w/o glyco mRNA opt Design2
ggggcgcugccuacggagguggcagccaucuccuucucggcaucaagcuuaccauggacgccaugaagcgcggccugugcugcgugcuccugcugugcggggccgucuucgugagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcaggugcgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcggcgggggcgggagcggcgggggcggccaguacaucaaggccaacagcaaguucaucggcaucaccgagcuggugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaacaacgggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3131 - RNA, 1447 nt, Artificial Sequence
  SP VLP peptide linker P2 VP8* P[6]-short w/o glyco mRNA opt Design2
ggggcgcugccuacggagguggcagccaucuccuucucggcaucaagcuuaccauggacgccaugaagcgcggccugugcugcgugcuccugcugugcggggccgucuucgugagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcaggugcgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcggcgggggcgggagcggcgggggcggccaguacaucaaggccaacagcaaguucaucggcaucaccgagcugguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3132 - RNA, 1444 nt, Artificial Sequence
  SP VLP peptide linker P2 VP8* P[8]-short w/o glyco mRNA opt Design2
ggggcgcugccuacggagguggcagccaucuccuucucggcaucaagcuuaccauggacgccaugaagcgcggccugugcugcgugcuccugcugugcggggccgucuucgugagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcaggugcgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcggcgggggcgggagcggcgggggcggccaguacaucaaggccaacagcaaguucaucggcaucaccgagcugcucgacggcccguaccagccgacgaccuucaccccgcccaccgacuacuggauccugaucacguccaacaccaacggggugguguacgagagcacccagaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3133 - RNA, 1444 nt, Artificial Sequence
  SP VLP peptide linker P2 VP8* P[8]-Wa-VirWa-shortw/o glyco mRNA opt Design2
ggggcgcugccuacggagguggcagccaucuccuucucggcaucaagcuuaccauggacgccaugaagcgcggccugugcugcgugcuccugcugugcggggccgucuucgugagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcaggugcgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcggcgggggcgggagcggcgggggcggccaguacaucaaggccaacagcaaguucaucggcaucaccgagcugcucgacgggcccuaccagccgacgaccuucaccccgcccaacgacuacuggauccugaucaacagcaacaccaacggcgucguguacgaguccacgcagaacagcgacuucuggaccgccguggucgccaucgagccccacgugaacccgguggaccgccaguacaccaucuucggggaguccaagcaguucaacguccggaacgacagcaacaaguggaaguuccuggagauguuccgcuccagcucccagaacgaguucuacaaccggcgcacccucacgagcgacacccggcuggugggcauccugaaguacggcgggcgcguguggaccuuccacggcgagaccccgcgggccacgaccgacuccagcuccaccgccaaccucaaccagaucagcaucaccauccacuccgaguucuacaucaucccccgcagccaggagagcaagugcaacgaguacaucaacaacgggcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3134 - RNA, 3496 nt, Artificial Sequence
  R3709/R3710 SP 4x(P2 VP8* P[4]-long w/o glyco) mRNA opt Design2
ggggcgcugccuacggagguggcagccaucuccuucucggcaucaagcuuaccauggacgccaugaagcgcggccugugcugcgugcuccugcugugcggggccgucuucgugagccaguacaucaaggccaacagcaaguucaucggcaucaccgagcuggccagccugaucuaccgccagcuccugaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaacaacgggcugccgcccauccagaacacccggaacguggugccgcucagccuguccagccgccaguacaucaaggccaacagcaaguucaucggcaucaccgagcuggccagccugaucuaccgccagcuccugaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaacaacgggcugccgcccauccagaacacccggaacguggugccgcucagccuguccagccgccaguacaucaaggccaacagcaaguucaucggcaucaccgagcuggccagccugaucuaccgccagcuccugaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaacaacgggcugccgcccauccagaacacccggaacguggugccgcucagccuguccagccgccaguacaucaaggccaacagcaaguucaucggcaucaccgagcuggccagccugaucuaccgccagcuccugaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaacaacgggcugccgcccauccagaacacccggaacguggugccgcucagccuguccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3135 - RNA, 3496 nt, Artificial Sequence
  R3719/R3720 SP 4x(P2 VP8* P[6]-long w/o glyco) mRNA opt Design2
ggggcgcugccuacggagguggcagccaucuccuucucggcaucaagcuuaccauggacgccaugaagcgcggccugugcugcgugcuccugcugugcggggccgucuucgugagccaguacaucaaggccaacagcaaguucaucggcaucaccgagcuggccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcaggucgugcucgagggcacgcagaagaccgacaucuggguggcccugcugcucguggagccgcaggucaccaaccagagccggcaguacacccuguucggggagacgaagcagaucaccguggagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgccaguacaucaaggccaacagcaaguucaucggcaucaccgagcuggccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcaggucgugcucgagggcacgcagaagaccgacaucuggguggcccugcugcucguggagccgcaggucaccaaccagagccggcaguacacccuguucggggagacgaagcagaucaccguggagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgccaguacaucaaggccaacagcaaguucaucggcaucaccgagcuggccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcaggucgugcucgagggcacgcagaagaccgacaucuggguggcccugcugcucguggagccgcaggucaccaaccagagccggcaguacacccuguucggggagacgaagcagaucaccguggagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgccaguacaucaaggccaacagcaaguucaucggcaucaccgagcuggccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcaggucgugcucgagggcacgcagaagaccgacaucuggguggcccugcugcucguggagccgcaggucaccaaccagagccggcaguacacccuguucggggagacgaagcagaucaccguggagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3136 - RNA, 3496 nt, Artificial Sequence
  R3689/R3690 SP 4x(P2 VP8* P[8]-long w/o glyco) mRNA opt Design2
ggggcgcugccuacggagguggcagccaucuccuucucggcaucaagcuuaccauggacgccaugaagcgcggccugugcugcgugcuccugcugugcggggccgucuucgugagccaguacaucaaggccaacagcaaguucaucggcaucaccgagcuggccagccugaucuaccgccagcuccugaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacaccaacggggugguguacgagagcacccagaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgccaguacaucaaggccaacagcaaguucaucggcaucaccgagcuggccagccugaucuaccgccagcuccugaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacaccaacggggugguguacgagagcacccagaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgccaguacaucaaggccaacagcaaguucaucggcaucaccgagcuggccagccugaucuaccgccagcuccugaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacaccaacggggugguguacgagagcacccagaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgccaguacaucaaggccaacagcaaguucaucggcaucaccgagcuggccagccugaucuaccgccagcuccugaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacaccaacggggugguguacgagagcacccagaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3137 - RNA, 4028 nt, Artificial Sequence
  R3892/R3893 multicistronic P2 P[8]-[6]-[4]-long EMCV-IRES-4 mRNA opt Design2
ggggcgcugccuacggagguggcagccaucuccuucucggcaucaagcuuaccaugcaguacaucaaggccaacagcaaguucaucggcaucaccgagcuggccagccugaucuaccgccagcuccugaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcugauugaaagccgggggugggagauccggauugccagucugcucgauaucgcaggcuggguccgugacuacccacucccccuuuaauuccgccccucucccuccccccccccuaacguuacuggccgaagccgcuuggaauaaggccggugugcguuugucuauauguuauuuuccaccauauugccgucuuuuggcaaugugagggcccggaaaccuggcccugucuucuugacgagcauuccuaggggucuuuccccucucgccaaaggaaugcaaggucuguugaaugucgugaaggaagcaguuccucuggaagcuucuugaagacaaacaacgucuguagcgacccuuugcaggcagcggaaccccccaccuggcgacaggugccucugcggccaaaagccacguguauaagauacaccugcaaaggcggcacaaccccagugccacguugugaguuggauaguuguggaaagagucaaauggcucuccucaagcguauucaacaaggggcugaaggaugcccagaagguaccccauuguaugggaucugaucuggggccucggugcacaugcuuuacguguguuuagucgagguuaaaaaacgucuaggccccccgaaccacggggacgugguuuuccuuugaaaaacacgaugauaauagaucuaccaugcaguacaucaaggccaacagcaaguucaucggcaucaccgagcuggccagccugaucuaccgccagcuccugaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugauugaaagccgggggugggagauccggauugccagucugcucgauaucgcaggcuggguccgugacuacccacucccccuuuaauuccgccccucucccuccccccccccuaacguuacuggccgaagccgcuuggaauaaggccggugugcguuugucuauauguuauuuuccaccauauugccgucuuuuggcaaugugagggcccggaaaccuggcccugucuucuugacgagcauuccuaggggucuuuccccucucgccaaaggaaugcaaggucuguugaaugucgugaaggaagcaguuccucuggaagcuucuugaagacaaacaacgucuguagcgacccuuugcaggcagcggaaccccccaccuggcgacaggugccucugcggccaaaagccacguguauaagauacaccugcaaaggcggcacaaccccagugccacguugugaguuggauaguuguggaaagagucaaauggcucuccucaagcguauucaacaaggggcugaaggaugcccagaagguaccccauuguaugggaucugaucuggggccucggugcacaugcuuuacguguguuuagucgagguuaaaaaacgucuaggccccccgaaccacggggacgugguuuuccuuugaaaaacacgaugauaauagaucuaccaugcaguacaucaaggccaacagcaaguucaucggcaucaccgagcuggccagccugaucuaccgccagcuccugaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3138 - RNA, 3608 nt, Artificial Sequence
  R3898/R3899 multicistronic P2 P[8]-[6]-[4]-long FMDV-IRES mRNA opt Design2
ggggcgcugccuacggagguggcagccaucuccuucucggcaucaagcuuaccaugcaguacaucaaggccaacagcaaguucaucggcaucaccgagcuggccagccugaucuaccgccagcuccugaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcugaagcagguuuccccaacugacacaaaacgugcaacuugaaacuccgccuggucuuuccaggucuagagggguaacacuuuguacugcguuuggcuccacgcucgauccacuggcgaguguuaguaacagcacuguugcuucguagcggagcaugacggccgugggaacuccuccuugguaacaaggacccacggggccaaaagccacgcccacacgggcccgucaugugugcaaccccagcacggcgacuuuacugcgaaacccacuuuaaagugacauugaaacugguacccacacacuggugacaggcuaaggaugcccuucagguaccccgagguaacacgcgacacucgggaucugagaaggggacuggggcuucuauaaaagcgcucgguuuaaaaagcuucuaugccugaauaggugaccggaggucggcaccuuuccuuuacaauuaaagacccuaugcaguacaucaaggccaacagcaaguucaucggcaucaccgagcuggccagccugaucuaccgccagcuccugaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaagcagguuuccccaacugacacaaaacgugcaacuugaaacuccgccuggucuuuccaggucuagagggguaacacuuuguacugcguuuggcuccacgcucgauccacuggcgaguguuaguaacagcacuguugcuucguagcggagcaugacggccgugggaacuccuccuugguaacaaggacccacggggccaaaagccacgcccacacgggcccgucaugugugcaaccccagcacggcgacuuuacugcgaaacccacuuuaaagugacauugaaacugguacccacacacuggugacaggcuaaggaugcccuucagguaccccgagguaacacgcgacacucgggaucugagaaggggacuggggcuucuauaaaagcgcucgguuuaaaaagcuucuaugccugaauaggugaccggaggucggcaccuuuccuuuacaauuaaagacccuaugcaguacaucaaggccaacagcaaguucaucggcaucaccgagcuggccagccugaucuaccgccagcuccugaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3139 - RNA, 2812 nt, Artificial Sequence
  R3886/R3887 multicistronic P2 P[4]-[6]-[8]-long F2A mRNA opt Design2
ggggcgcugccuacggagguggcagccaucuccuucucggcaucaagcuuaccaugcaguacaucaaggccaacagcaaguucaucggcaucaccgagcuggccagccugaucuaccgccagcuccugaccaacuccuacagcguggaccugcacgacgagaucgagcagaucggcuccgagaagacccagaacgucacggugaaccccgggccguucgcccagacccgguacgcgcccgugaacuggggccacggggagaucaacgacagcaccaccgucgagcccgugcucgacggccccuaccagcccacgaccuucaagccgcccaacgacuacuggcugcugaucuccagcaacaccgacgggguggucuacgaguccaccaacaacagcgacuucuggacggccgugaucgccguggagccccacgucaaccagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaacaacaucuccaucaucauccacagcgaguucuacaucaucccccgcagccaggaguccaagugcaacgaguacaucaacaacgggcugccgcccauccagaacacccggaacguggugccgcucagccuguccagccgcgugaagcagacacucaauuucgaccuucugaaguuggcuggagauguugagucuaacccaggccccaugcaguacaucaaggccaacagcaaguucaucggcaucaccgagcuggccagccugaucuaccgccagcuccugaccaacuccuacaccguggagcugagcgacgagaucaacacgaucggcuccgagaagaaccagaacgucaccaucaaccccgggcccuucgcccagaccaacuacgcgcccgugaccuggagccacggcgaggugaacgacuccacgaccaucgagcccguccucgacgggcccuaccagccgaccaacuucaagccgcccaacgacuacuggauccugcugaaccccaccaaccagcagguggugcucgagggcacgaacaagaccgacaucugggucgcccugcugcucguggagccgaacgugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcgucaaacagaccuugaacuucgacuugcucaaacuggccggggauguggaguccaauccuggaccuaugcaguacaucaaggccaacagcaaguucaucggcaucaccgagcuggccagccugaucuaccgccagcuccugaccaacuccuacagcguggaccugcacgacgagaucgagcagaucggcuccgagaagacccagaacgucacggugaaccccgggcccuucgcccagacccgguacgcgcccgugaacuggggccacggggagaucaacgacagcaccaccgucgagcccauccucgacggcccguaccagccgacgaccuucaccccgcccaccgacuacuggauccugaucacguccaacaccaacggggugguguacgagagcaccaacaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3140 - RNA, 4208 nt, Artificial Sequence
  R3894/R3895 multicistronic SP P2 P[8]-[6]-[4]-long w/o glyco EMCV-IRES-4 mRNA opt Design2
ggggcgcugccuacggagguggcagccaucuccuucucggcaucaagcuuaccauggacgccaugaagcgcggccugugcugcgugcuccugcugugcggggccgucuucgugagccaguacaucaaggccaacagcaaguucaucggcaucaccgagcuggccagccugaucuaccgccagcuccugaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacaccaacggggugguguacgagagcacccagaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcugauugaaagccgggggugggagauccggauugccagucugcucgauaucgcaggcuggguccgugacuacccacucccccuuuaauuccgccccucucccuccccccccccuaacguuacuggccgaagccgcuuggaauaaggccggugugcguuugucuauauguuauuuuccaccauauugccgucuuuuggcaaugugagggcccggaaaccuggcccugucuucuugacgagcauuccuaggggucuuuccccucucgccaaaggaaugcaaggucuguugaaugucgugaaggaagcaguuccucuggaagcuucuugaagacaaacaacgucuguagcgacccuuugcaggcagcggaaccccccaccuggcgacaggugccucugcggccaaaagccacguguauaagauacaccugcaaaggcggcacaaccccagugccacguugugaguuggauaguuguggaaagagucaaauggcucuccucaagcguauucaacaaggggcugaaggaugcccagaagguaccccauuguaugggaucugaucuggggccucggugcacaugcuuuacguguguuuagucgagguuaaaaaacgucuaggccccccgaaccacggggacgugguuuuccuuugaaaaacacgaugauaauagaucuaccauggacgccaugaagcgcggccugugcugcgugcuccugcugugcggggccgucuucgugagccaguacaucaaggccaacagcaaguucaucggcaucaccgagcuggccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugauugaaagccgggggugggagauccggauugccagucugcucgauaucgcaggcuggguccgugacuacccacucccccuuuaauuccgccccucucccuccccccccccuaacguuacuggccgaagccgcuuggaauaaggccggugugcguuugucuauauguuauuuuccaccauauugccgucuuuuggcaaugugagggcccggaaaccuggcccugucuucuugacgagcauuccuaggggucuuuccccucucgccaaaggaaugcaaggucuguugaaugucgugaaggaagcaguuccucuggaagcuucuugaagacaaacaacgucuguagcgacccuuugcaggcagcggaaccccccaccuggcgacaggugccucugcggccaaaagccacguguauaagauacaccugcaaaggcggcacaaccccagugccacguugugaguuggauaguuguggaaagagucaaauggcucuccucaagcguauucaacaaggggcugaaggaugcccagaagguaccccauuguaugggaucugaucuggggccucggugcacaugcuuuacguguguuuagucgagguuaaaaaacgucuaggccccccgaaccacggggacgugguuuuccuuugaaaaacacgaugauaauagaucuaccauggacgccaugaagcgcggccugugcugcgugcuccugcugugcggggccgucuucgugagccaguacaucaaggccaacagcaaguucaucggcaucaccgagcuggccagccugaucuaccgccagcuccugaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaacaacgggcugccgcccauccagaacacccggaacguggugccgcucagccuguccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3141 - RNA, 3788 nt, Artificial Sequence
  R3900/R3901 multicistronic SP P2 P[8]-[6]-[4]-long w/o glyco FMDV-IRES mRNA opt Design2
ggggcgcugccuacggagguggcagccaucuccuucucggcaucaagcuuaccauggacgccaugaagcgcggccugugcugcgugcuccugcugugcggggccgucuucgugagccaguacaucaaggccaacagcaaguucaucggcaucaccgagcuggccagccugaucuaccgccagcuccugaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacaccaacggggugguguacgagagcacccagaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcugaagcagguuuccccaacugacacaaaacgugcaacuugaaacuccgccuggucuuuccaggucuagagggguaacacuuuguacugcguuuggcuccacgcucgauccacuggcgaguguuaguaacagcacuguugcuucguagcggagcaugacggccgugggaacuccuccuugguaacaaggacccacggggccaaaagccacgcccacacgggcccgucaugugugcaaccccagcacggcgacuuuacugcgaaacccacuuuaaagugacauugaaacugguacccacacacuggugacaggcuaaggaugcccuucagguaccccgagguaacacgcgacacucgggaucugagaaggggacuggggcuucuauaaaagcgcucgguuuaaaaagcuucuaugccugaauaggugaccggaggucggcaccuuuccuuuacaauuaaagacccuauggacgccaugaagcgcggccugugcugcgugcuccugcugugcggggccgucuucgugagccaguacaucaaggccaacagcaaguucaucggcaucaccgagcuggccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcugaagcagguuuccccaacugacacaaaacgugcaacuugaaacuccgccuggucuuuccaggucuagagggguaacacuuuguacugcguuuggcuccacgcucgauccacuggcgaguguuaguaacagcacuguugcuucguagcggagcaugacggccgugggaacuccuccuugguaacaaggacccacggggccaaaagccacgcccacacgggcccgucaugugugcaaccccagcacggcgacuuuacugcgaaacccacuuuaaagugacauugaaacugguacccacacacuggugacaggcuaaggaugcccuucagguaccccgagguaacacgcgacacucgggaucugagaaggggacuggggcuucuauaaaagcgcucgguuuaaaaagcuucuaugccugaauaggugaccggaggucggcaccuuuccuuuacaauuaaagacccuauggacgccaugaagcgcggccugugcugcgugcuccugcugugcggggccgucuucgugagccaguacaucaaggccaacagcaaguucaucggcaucaccgagcuggccagccugaucuaccgccagcuccugaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaacaacgggcugccgcccauccagaacacccggaacguggugccgcucagccuguccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3142 - RNA, 2992 nt, Artificial Sequence
  R3888/R3889 multicistronic SP P2 P[4]-[6]-[8]-long w/o glyco F2A mRNA opt Design2
ggggcgcugccuacggagguggcagccaucuccuucucggcaucaagcuuaccauggacgccaugaagcgcggccugugcugcgugcuccugcugugcggggccgucuucgugagccaguacaucaaggccaacagcaaguucaucggcaucaccgagcuggccagccugaucuaccgccagcuccugaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaacaacgggcugccgcccauccagaacacccggaacguggugccgcucagccuguccagccgcgugaagcagacacucaauuucgaccuucugaaguuggcuggagauguugagucuaacccaggccccauggacgccaugaagcgcggccugugcugcgugcuccugcugugcggggccgucuucgugagccaguacaucaaggccaacagcaaguucaucggcaucaccgagcuggccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcgucaaacagaccuugaacuucgacuugcucaaacuggccggggauguggaguccaauccuggaccuauggacgccaugaagcgcggccugugcugcgugcuccugcugugcggggccgucuucgugagccaguacaucaaggccaacagcaaguucaucggcaucaccgagcuggccagccugaucuaccgccagcuccugaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacaccaacggggugguguacgagagcacccagaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3143 - RNA, 4622 nt, Artificial Sequence
  R3896/R3897 multicistronic SP P2 P[8]-[6]-[4]-long w/o glyco w TM domain EMCV-IRES-4 mRNA opt Design2
ggggcgcugccuacggagguggcagccaucuccuucucggcaucaagcuuaccauggacgccaugaagcgcggccugugcugcgugcuccugcugugcggggccgucuucgugagccaguacaucaaggccaacagcaaguucaucggcaucaccgagcuggccagccugaucuaccgccagcuccugaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacaccaacggggugguguacgagagcacccagaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcaagcucgaguccacgcggaucuaccagauccuggcgaucuacagcaccgucgccagcucccuggugcucguggucagccugggggccaucuccuucuggaugugcagcaacggcucccugcagugccgcaucugcaucugauugaaagccgggggugggagauccggauugccagucugcucgauaucgcaggcuggguccgugacuacccacucccccuuuaauuccgccccucucccuccccccccccuaacguuacuggccgaagccgcuuggaauaaggccggugugcguuugucuauauguuauuuuccaccauauugccgucuuuuggcaaugugagggcccggaaaccuggcccugucuucuugacgagcauuccuaggggucuuuccccucucgccaaaggaaugcaaggucuguugaaugucgugaaggaagcaguuccucuggaagcuucuugaagacaaacaacgucuguagcgacccuuugcaggcagcggaaccccccaccuggcgacaggugccucugcggccaaaagccacguguauaagauacaccugcaaaggcggcacaaccccagugccacguugugaguuggauaguuguggaaagagucaaauggcucuccucaagcguauucaacaaggggcugaaggaugcccagaagguaccccauuguaugggaucugaucuggggccucggugcacaugcuuuacguguguuuagucgagguuaaaaaacgucuaggccccccgaaccacggggacgugguuuuccuuugaaaaacacgaugauaauagaucuaccauggacgccaugaagcgcggccugugcugcgugcuccugcugugcggggccgucuucgugagccaguacaucaaggccaacagcaaguucaucggcaucaccgagcuggccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcaagcucgaguccacgcggaucuaccagauccuggcgaucuacagcaccgucgccagcucccuggugcucguggucagccugggggccaucuccuucuggaugugcagcaacggcucccugcagugccgcaucugcaucugauugaaagccgggggugggagauccggauugccagucugcucgauaucgcaggcuggguccgugacuacccacucccccuuuaauuccgccccucucccuccccccccccuaacguuacuggccgaagccgcuuggaauaaggccggugugcguuugucuauauguuauuuuccaccauauugccgucuuuuggcaaugugagggcccggaaaccuggcccugucuucuugacgagcauuccuaggggucuuuccccucucgccaaaggaaugcaaggucuguugaaugucgugaaggaagcaguuccucuggaagcuucuugaagacaaacaacgucuguagcgacccuuugcaggcagcggaaccccccaccuggcgacaggugccucugcggccaaaagccacguguauaagauacaccugcaaaggcggcacaaccccagugccacguugugaguuggauaguuguggaaagagucaaauggcucuccucaagcguauucaacaaggggcugaaggaugcccagaagguaccccauuguaugggaucugaucuggggccucggugcacaugcuuuacguguguuuagucgagguuaaaaaacgucuaggccccccgaaccacggggacgugguuuuccuuugaaaaacacgaugauaauagaucuaccauggacgccaugaagcgcggccugugcugcgugcuccugcugugcggggccgucuucgugagccaguacaucaaggccaacagcaaguucaucggcaucaccgagcuggccagccugaucuaccgccagcuccugaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaacaacgggcugccgcccauccagaacacccggaacguggugccgcucagccuguccagccgcaagcucgaguccacgcggaucuaccagauccuggcgaucuacagcaccgucgccagcucccuggugcucguggucagccugggggccaucuccuucuggaugugcagcaacggcucccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3144 - RNA, 4202 nt, Artificial Sequence
  R3902/R3903 multicistronic SP P2 P[8]-[6]-[4]-long w/o glyco w TM domain FMDV-IRES mRNA opt Design2
ggggcgcugccuacggagguggcagccaucuccuucucggcaucaagcuuaccauggacgccaugaagcgcggccugugcugcgugcuccugcugugcggggccgucuucgugagccaguacaucaaggccaacagcaaguucaucggcaucaccgagcuggccagccugaucuaccgccagcuccugaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacaccaacggggugguguacgagagcacccagaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcaagcucgaguccacgcggaucuaccagauccuggcgaucuacagcaccgucgccagcucccuggugcucguggucagccugggggccaucuccuucuggaugugcagcaacggcucccugcagugccgcaucugcaucugaagcagguuuccccaacugacacaaaacgugcaacuugaaacuccgccuggucuuuccaggucuagagggguaacacuuuguacugcguuuggcuccacgcucgauccacuggcgaguguuaguaacagcacuguugcuucguagcggagcaugacggccgugggaacuccuccuugguaacaaggacccacggggccaaaagccacgcccacacgggcccgucaugugugcaaccccagcacggcgacuuuacugcgaaacccacuuuaaagugacauugaaacugguacccacacacuggugacaggcuaaggaugcccuucagguaccccgagguaacacgcgacacucgggaucugagaaggggacuggggcuucuauaaaagcgcucgguuuaaaaagcuucuaugccugaauaggugaccggaggucggcaccuuuccuuuacaauuaaagacccuauggacgccaugaagcgcggccugugcugcgugcuccugcugugcggggccgucuucgugagccaguacaucaaggccaacagcaaguucaucggcaucaccgagcuggccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcaagcucgaguccacgcggaucuaccagauccuggcgaucuacagcaccgucgccagcucccuggugcucguggucagccugggggccaucuccuucuggaugugcagcaacggcucccugcagugccgcaucugcaucugaagcagguuuccccaacugacacaaaacgugcaacuugaaacuccgccuggucuuuccaggucuagagggguaacacuuuguacugcguuuggcuccacgcucgauccacuggcgaguguuaguaacagcacuguugcuucguagcggagcaugacggccgugggaacuccuccuugguaacaaggacccacggggccaaaagccacgcccacacgggcccgucaugugugcaaccccagcacggcgacuuuacugcgaaacccacuuuaaagugacauugaaacugguacccacacacuggugacaggcuaaggaugcccuucagguaccccgagguaacacgcgacacucgggaucugagaaggggacuggggcuucuauaaaagcgcucgguuuaaaaagcuucuaugccugaauaggugaccggaggucggcaccuuuccuuuacaauuaaagacccuauggacgccaugaagcgcggccugugcugcgugcuccugcugugcggggccgucuucgugagccaguacaucaaggccaacagcaaguucaucggcaucaccgagcuggccagccugaucuaccgccagcuccugaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaacaacgggcugccgcccauccagaacacccggaacguggugccgcucagccuguccagccgcaagcucgaguccacgcggaucuaccagauccuggcgaucuacagcaccgucgccagcucccuggugcucguggucagccugggggccaucuccuucuggaugugcagcaacggcucccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3145 - RNA, 3406 nt, Artificial Sequence
  R3890/R3891 multicistronic SP P2 P[4]-[6]-[8]-long w/o glyco w TM domain F2A mRNA opt Design2
ggggcgcugccuacggagguggcagccaucuccuucucggcaucaagcuuaccauggacgccaugaagcgcggccugugcugcgugcuccugcugugcggggccgucuucgugagccaguacaucaaggccaacagcaaguucaucggcaucaccgagcuggccagccugaucuaccgccagcuccugaccaacuccuacagcguggaccugcacgacgagaucgagcagaucggcuccgagaagacccagcaggucacggugaaccccgggccguucgcccagacccgguacgcgcccgugaacuggggccacggggagauccaggacagcaccaccgucgagcccgugcucgacggccccuaccagcccacgaccuucaagccgcccaacgacuacuggcugcugaucuccagcaacaccgacgggguggucuacgaguccacccagaacagcgacuucuggacggccgugaucgccguggagccccacguccagcagaccaaccgccaguacgugcucuucggcgagaacaagcaguucaacaucgagaacuccagcgacaaguggaaguucuucgagauguucaagggcaacucccagagcgacuucuccaaccggcgcacccugaccagcuccaaccggcugguggggaugcucaaguacggcgggcgcgucuggacguuccacggcgagaccccgcgggccaccaccgacagcuccagcacggccgaccugaaccagaucuccaucaucauccacagcgaguucuacaucaucccccgcagccaggaguccaagugcaacgaguacaucaacaacgggcugccgcccauccagaacacccggaacguggugccgcucagccuguccagccgcaagcucgaguccacgcggaucuaccagauccuggcgaucuacagcaccgucgccagcucccuggugcucguggucagccugggggccaucuccuucuggaugugcagcaacggcucccugcagugccgcaucugcaucgugaagcagacacucaauuucgaccuucugaaguuggcuggagauguugagucuaacccaggccccauggacgccaugaagcgcggccugugcugcgugcuccugcugugcggggccgucuucgugagccaguacaucaaggccaacagcaaguucaucggcaucaccgagcuggccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugaccaaccagagccggcaguacacccuguucggggagacgaagcagaucaccgucgagaacaacaccaacaaguggaaguucuucgagauguuccgcuccagcguguccgccgaguuccagcacaagcggacccugacgagcgacaccaagcucgccggcuucaugaaguucuacaacuccguguggaccuuccacggcgagacccccaacgccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggaacaucguccccguggcgcucagcucccgcaagcucgaguccacgcggaucuaccagauccuggcgaucuacagcaccgucgccagcucccuggugcucguggucagccugggggccaucuccuucuggaugugcagcaacggcucccugcagugccgcaucugcaucgucaaacagaccuugaacuucgacuugcucaaacuggccggggauguggaguccaauccuggaccuauggacgccaugaagcgcggccugugcugcgugcuccugcugugcggggccgucuucgugagccaguacaucaaggccaacagcaaguucaucggcaucaccgagcuggccagccugaucuaccgccagcuccugaccaacuccuacagcguggaccugcacgacgagaucgagcagaucggcuccgagaagacccagcaggucacggugaaccccgggcccuucgcccagacccgguacgcgcccgugaacuggggccacggggagauccaggacagcaccaccgucgagcccauccucgacggcccguaccagccgacgaccuucaccccgcccaccgacuacuggauccugaucacguccaacaccaacggggugguguacgagagcacccagaacuccgacuucuggaccgccgucaucgccguggagccccacgugaacccggucgaccgccaguacaacguguucggcgagaacaagcaguucaacgugcggaacgacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaacaacggccugcccccgauccagaacacccggaacguggucccccugagccucuccagccgcaagcucgaguccacgcggaucuaccagauccuggcgaucuacagcaccgucgccagcucccuggugcucguggucagccugggggccaucuccuucuggaugugcagcaacggcucccugcagugccgcaucugcaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3146 - RNA, 1429 nt, Artificial Sequence
  R4897
ggggcgcugccuacggagguggcagccaucuccuucucggcaucaagcuuaccaugcagaucuacgagggcaagcugaccgccgaggggcuccgcuucggcaucguggccagccgguucaaccacgcgcuggucgaccgccugguggagggggccaucgacgccaucgugcggcacggcgggcgcgaggaggacaucacccucguccgggugcccggcuccugggagaucccgguggccgccggcgagcuggcccgcaaggaggacaucgacgcggucaucgccaucggggugcugauccggggcgccacgccccacuucgacuacaucgccagcgagguguccaaggggcucgcggaccugagccuggagcuccgcaagcccaucaccuucggcgucaucaccgccgacacccuggagcaggccaucgagcgggccgggacgaagcacggcaacaagggcugggaggccgcgcuguccgccaucgagauggccaaccucuucaagagccugcgcggcgggagcggcggguccggcgggagcggcggcuccgggggcgggcaguacaucaaggccaacagcaaguucaucggcaucaccgagcugggcagcggguccggccucgacggcccguaccagccgacgaccuucaccccgcccaccgacuacuggauccugaucacguccaacacccagggggugguguacgagagcacccagaacuccgacuucuggaccgccgucaucgccguggagccccacgugaacccggucgaccgccaguacaacguguucggcgagaacaagcaguucaacgugcggcaggacagcgacaaguggaaguuccuggagauguuccgcggcuccagccagaacgacuucuacaaccggcgcacgcucaccuccgacacccggcuggucgggauccugaaguacggcgggcgcguguggaccuuccacggcgagacgccccgggccaccaccgacagcuccaacaccgccaaccucgacgggaucagcaucacgauccacuccgaguucuacaucaucccccgcagccaggaguccaagugcaacgaguacaucaaccagggccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3147 - protein, 15 aa, Artificial Sequence
  Clostridium tetani P2 helper peptide
QYIKANSKFIGITEL

SEQ ID NO: 3148 - protein, 21 aa, Artificial Sequence
  Homo sapiens signal peptide of TPA
MDAMKRGLCCVLLLCGAVFVS

SEQ ID NO: 3149 - protein, 18 aa, Artificial Sequence
  Homo sapiens signal peptide of HSA
MKWVTFISLLFLFSSAYS

SEQ ID NO: 3150 - protein, 18 aa, Artificial Sequence
  signal peptide of IgE
MDWTWILFLVAAATRVHS

SEQ ID NO: 3151 - protein, 24 aa, Artificial Sequence
  Homo sapiens signal peptide of CD5
MPMGSLQPLATLYLLGMLVASCLG

SEQ ID NO: 3152 - protein, 24 aa, Artificial Sequence
  Influenza virus signal peptide of HLA-A2
MAVMAPRTLVLLLSGALALTQTWA

SEQ ID NO: 3153 - protein, 25 aa, Artificial Sequence
  Influenza virus signal peptide of HLA-A2
MAVMAPRTLVLLLSGALALTQTWAG

SEQ ID NO: 3154 - protein, 17 aa, Artificial Sequence
  Gaussia princeps signal peptide
MGVKVLFALICIAVAEA

SEQ ID NO: 3155 - protein, 19 aa, Artificial Sequence
  Homo sapiens signal peptide of immunoglobulin
MEFGLSWVFLVALFRGVQC

SEQ ID NO: 3156 - protein, 14 aa, Artificial Sequence
  Homo sapiens signal peptide of IL-2
MQLLSCIALILALV

SEQ ID NO: 3157 - protein, 18 aa, Artificial Sequence
  Homo sapiens signal peptide of chymotrypsinogen
MAFLWLLSCWALLGTTFG

SEQ ID NO: 3158 - protein, 19 aa, Artificial Sequence
  Homo sapiens signal peptide of immunoglobulin
MDWTWRVFCLLAVTPGAHP

SEQ ID NO: 3159 - protein, 19 aa, Artificial Sequence
  Homo sapiens signal peptide of immunoglobulin
MAWSPLFLTLITHCAGSWA

SEQ ID NO: 3160 - protein, 46 aa, Artificial Sequence
  Influenza virus Transmembrane domain TM of HA of Influenza virus
KLESTRIYQILAIYSTVASSLVLVVSLGAISFWMCSNGSLQCRICI

SEQ ID NO: 3161 - protein, 17 aa, Artificial Sequence
  Human immunodeficiency virus 1 Transmembrane domain of Env of HIV-1
LILGLVIICNASNNLWV

SEQ ID NO: 3162 - protein, 22 aa, Artificial Sequence
  Human immunodeficiency virus 1 Transmembrane domain of Env of HIV-1
GIGAMIFGFLGAAGSTMGAASI

SEQ ID NO: 3163 - protein, 23 aa, Artificial Sequence
  Human immunodeficiency virus 1 Transmembrane domain of Env of HIV-1
LWYIRLFIMIVGGLIGLRIIFAV

SEQ ID NO: 3164 - protein, 23 aa, Artificial Sequence
  Equine infectious anemia virus Transmembrane domain of Env of EIAV
AIVAAIVAATAIAASATMSYVAL

SEQ ID NO: 3165 - protein, 23 aa, Artificial Sequence
  Equine infectious anemia virus Transmembrane domain of Env of EIAV
WIPGLGASIIKYIVMFLLIYLLL

SEQ ID NO: 3166 - protein, 22 aa, Artificial Sequence
  Equine infectious anemia virus Transmembrane domain of Env of EIAV
LFWGLVIIVGRIAGYGLRGLAV

SEQ ID NO: 3167 - protein, 23 aa, Artificial Sequence
  Murine leukemia virus Transmembrane domain of Env of MLV
WFTTLISTIMGPLIVLLLILLLG

SEQ ID NO: 3168 - protein, 23 aa, Artificial Sequence
  Mouse mammary tumor virus Transmembrane domain env of mouse mammery tumor virus
FVAAIILGISALIAIITSFAVAT

SEQ ID NO: 3169 - protein, 23 aa, Artificial Sequence
  Mouse mammary tumor virus Transmembrane domain env of mouse mammery tumor virus
YFIFIGVGALLLVIVLMIFPIVF

SEQ ID NO: 3170 - protein, 23 aa, Artificial Sequence
  Vesicular stomatitis virus Transmembrane domain of G protein of VSV
AVIIGFVILMFLIKLIGVLSSLF

SEQ ID NO: 3171 - protein, 20 aa, Artificial Sequence
  Rabies virus Transmembrane domain of G protein of Rabies
VLMGAGVLTALMLMIFLMTC

SEQ ID NO: 3172 - protein, 149 aa, Artificial Sequence
  Woodchuck hepatitis virus VLP forming WHcAg
DIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 3173 - protein, 221 aa, Artificial Sequence
  Alfalfa mosaic virus VLP forming Alfalfa MV CP
MSSSQKKAGGKAGKPTKRSQNYAALRKAQLPKPPALKVPVVKPTNTILPQTGCVWQSLGTPLSLSSFNGLGVRFLYSFLKDFAGPRILEEDLIYRMVFSITPSYAGTFCLTDDVTTEDGRAVAHGNPMQEFPHGAFHANEKFGFELVFTAPTHAGMQNQNFKHSYAVALCLDFDAQPEGSKNPSYRFNEVWVERKAFPRAGPLRSLITVGLLDEADDLDRH

SEQ ID NO: 3174 - protein, 9 aa, Artificial Sequence
  peptide linker 1
GGGGSGGGG

SEQ ID NO: 3175 - protein, 14 aa, Artificial Sequence
  peptide linker 2
GGGGSGGGGSGGGG

SEQ ID NO: 3176 - protein, 5 aa, Artificial Sequence
  peptide linker 3
GSGSG

SEQ ID NO: 3177 - protein, 22 aa, Artificial Sequence
  Foot-and-mouth disease virus F2Amod1
VKQTLNFDLLKLAGDVESNPGP

SEQ ID NO: 3178 - protein, 22 aa, Artificial Sequence
  Foot-and-mouth disease virus F2Amod2
VKQTLNFDLLKLAGDVESNPGP

SEQ ID NO: 3179 - RNA, 66 nt, Artificial Sequence
  Foot-and-mouth disease virus F2Amod1 CDS wt
gugaagcagacacucaauuucgaccuucugaaguuggcuggagauguugagucuaacccaggcccc

SEQ ID NO: 3180 - RNA, 66 nt, Artificial Sequence
  Foot-and-mouth disease virus F2Amod2 CDS wt
gucaaacagaccuugaacuucgacuugcucaaacuggccggggauguggaguccaauccuggaccu

SEQ ID NO: 3181 - RNA, 671 nt, Artificial Sequence
  Encephalomyocarditis virus EMCV-IRES-4 CDS wt
uugaaagccgggggugggagauccggauugccagucugcucgauaucgcaggcuggguccgugacuacccacucccccuuuaauuccgccccucucccuccccccccccuaacguuacuggccgaagccgcuuggaauaaggccggugugcguuugucuauauguuauuuuccaccauauugccgucuuuuggcaaugugagggcccggaaaccuggcccugucuucuugacgagcauuccuaggggucuuuccccucucgccaaaggaaugcaaggucuguugaaugucgugaaggaagcaguuccucuggaagcuucuugaagacaaacaacgucuguagcgacccuuugcaggcagcggaaccccccaccuggcgacaggugccucugcggccaaaagccacguguauaagauacaccugcaaaggcggcacaaccccagugccacguugugaguuggauaguuguggaaagagucaaauggcucuccucaagcguauucaacaaggggcugaaggaugcccagaagguaccccauuguaugggaucugaucuggggccucggugcacaugcuuuacguguguuuagucgagguuaaaaaacgucuaggccccccgaaccacggggacgugguuuuccuuugaaaaacacgaugauaauagaucuacc

SEQ ID NO: 3182 - RNA, 461 nt, Artificial Sequence
  Foot-and-mouth disease virus FMDV-IRES CDS wt
agcagguuuccccaacugacacaaaacgugcaacuugaaacuccgccuggucuuuccaggucuagagggguaacacuuuguacugcguuuggcuccacgcucgauccacuggcgaguguuaguaacagcacuguugcuucguagcggagcaugacggccgugggaacuccuccuugguaacaaggacccacggggccaaaagccacgcccacacgggcccgucaugugugcaaccccagcacggcgacuuuacugcgaaacccacuuuaaagugacauugaaacugguacccacacacuggugacaggcuaaggaugcccuucagguaccccgagguaacacgcgacacucgggaucugagaaggggacuggggcuucuauaaaagcgcucgguuuaaaaagcuucuaugccugaauaggugaccggaggucggcaccuuuccuuuacaauuaaagacccu

SEQ ID NO: 3183 - protein, 14 aa, Artificial Sequence
  carrier peptide 1
CRRRRRRRRRRRRC

SEQ ID NO: 3184 - protein, 13 aa, Artificial Sequence
  carrier peptide 2
CRRRRRRRRRRRR

SEQ ID NO: 3185 - RNA, 547 nt, Artificial Sequence
  R2025/R2391 isRNA (cargo) mRNA product
gggagaaagcucaagcuuauccaaguaggcuggucaccuguacaacguagccgguauuuuuuuuuuuuuuuuuuuuuugaccgucucaagguccaaguuagucugccuauaaaggugcggauccacagcugaugaaagacuugugcgguacgguuaaucuccccuuuuuuuuuuuuuuuuuuuuuaguaaaugcgucuacugaauccagcgaugaugcuggcccagaucuucgaccacaagugcauauaguagucaucgagggucgccuuuuuuuuuuuuuuuuuuuuuuuggcccaguucugagacuucgcuagagacuacaguuacagcugcaguaguaaccacugcggcuauugcaggaaaucccguucagguuuuuuuuuuuuuuuuuuuuuccgcucacuaugauuaagaaccagguggagugucacugcucucgaggucucacgagagcgcucgauacaguccuuggaagaaucuuuuuuuuuuuuuuuuuuuuuugugcgacgaucacagagaacuucuauucaugcaggucugcucuag

SEQ ID NO: 3186 - RNA, 546 nt, Artificial Sequence
  isRNA (cargo) 2 mRNA product
gggagaaagcucaagcuuauccaaguaggcuggucaccuguacaacguagccgguauuuuuuuuuuuuuuuuuuuuuugaccgucucaagguccaaguuagucugccuauaaaggugcggauccacagcugaugaaagacuugugcgguacgguuaaucuccccuuuuuuuuuuuuuuuuuuuuuaguaaaugcgucuacugaauccagcgaugaugcuggcccagaucuucgaccacaagugcauauaguagucaucgagggucgccuuuuuuuuuuuuuuuuuuuuuuuggcccaguucugagacuucgcuagagacuacaguuacagcugcaguaguaaccacugcggcuauugcaggaaaucccguucagguuuuuuuuuuuuuuuuuuuuuccgcucacuaugauuaagaaccagguggagugucacugcucucgaggucucacgagagcgcucgauacaguccuuggaagaaucuuuuuuuuuuuuuuuuuuuuuugugcgacgaucacagagaacuucuauucaugcaggucugcucua

SEQ ID NO: 3187 - RNA, 1083 nt, Artificial Sequence
  isRNA (cargo) 3 mRNA product
gggagaaagcucaagcuuauccaaguaggcuggucaccuguacaacguagccgguauuuuuuuuuuuuuuuuuuuuuugaccgucucaagguccaaguuagucugccuauaaaggugcggauccacagcugaugaaagacuugugcgguacgguuaaucuccccuuuuuuuuuuuuuuuuuuuuuaguaaaugcgucuacugaauccagcgaugaugcuggcccagaucuucgaccacaagugcauauaguagucaucgagggucgccuuuuuuuuuuuuuuuuuuuuuuuggcccaguucugagacuucgcuagagacuacaguuacagcugcaguaguaaccacugcggcuauugcaggaaaucccguucagguuuuuuuuuuuuuuuuuuuuuccgcucacuaugauuaagaaccagguggagugucacugcucucgaggucucacgagagcgcucgauacaguccuuggaagaaucuuuuuuuuuuuuuuuuuuuuuugugcgacgaucacagagaacuucuauucaugcaggucugcucuagaacgaacugaccugacgccugaacuuaugagcgugcguauuuuuuuuuuuuuuuuuuuuuuuccucccaacaaaugucgaucaauagcugggcuguuggagacgcgucagcaaaugccguggcuccauaggacguguagacuucuauuuuuuuuuuuuuuuuuuuuucccgggaccacaaauaauauucuugcuugguugggcgcaagggccccguaucaggucauaaacggguacauguugcacaggcuccuuuuuuuuuuuuuuuuuuuuuuucgcugaguuauuccggucucaaaagacggcagacgucagucgacaacacggucuaaagcagugcuacaaucugccguguucguguuuuuuuuuuuuuuuuuuuugugaaccuacacggcgugcacuguaguucgcaauucauaggguaccggcucagaguuaugccuugguugaaaacugcccagcauacuuuuuuuuuuuuuuuuuuuucauauucccaugcuaagcaagggaugccgcgagucauguuaagcuugaauu

SEQ ID NO: 3188 - DNA, 42 bp, Artificial Sequence
  5-UTR of human ribosomal protein Large 32 lacking the 5 terminal oligopyrimidine tract
ggcgctgcctacggaggtggcagccatctccttctcggcatc

SEQ ID NO: 3189 - RNA, 42 nt, Artificial Sequence
  5-UTR of human ribosomal protein Large 32 lacking the 5 terminal oligopyrimidine tract mRNA
ggcgcugccuacggagguggcagccaucuccuucucggcauc

SEQ ID NO: 3190 - DNA, 75 bp, Artificial Sequence
  5-UTR of human mitochondrial ATP synthase subunit alpha lacking the 5 terminal oligopyrimidine tract
gcggctcggccattttgtcccagtcagtccggaggctgcggctgcagaagtaccgcctgcggagtaactgcaaag

SEQ ID NO: 3191 - RNA, 75 nt, Artificial Sequence
  5-UTR of human mitochondrial ATP synthase subunit alpha lacking the 5 terminal oligopyrimidine tract mRNA
gcggcucggccauuuugucccagucaguccggaggcugcggcugcagaaguaccgccugcggaguaacugcaaag

SEQ ID NO: 3192 - DNA, 110 bp, Artificial Sequence
  3-UTR of Homo sapiens hemoglobin, alpha 1 (HBA1)
gctggagcctcggtggccatgcttcttgccccttgggcctccccccagcccctcctccccttcctgcacccgtacccccgtggtctttgaataaagtctgagtgggcggc

SEQ ID NO: 3193 - RNA, 110 nt, Artificial Sequence
  3-UTR of Homo sapiens hemoglobin, alpha 1 (HBA1) mRNA
gcuggagccucgguggccaugcuucuugccccuugggccuccccccagccccuccuccccuuccugcacccguacccccguggucuuugaauaaagucugagugggcggc

SEQ ID NO: 3194 - DNA, 108 bp, Artificial Sequence
  3-UTR of Homo sapiens hemoglobin, alpha 2 (HBA2)
gctggagcctcggtagccgttcctcctgcccgctgggcctcccaacgggccctcctcccctccttgcaccggcccttcctggtctttgaataaagtctgagtgggcag

SEQ ID NO: 3195 - RNA, 108 nt, Artificial Sequence
  3-UTR of Homo sapiens hemoglobin, alpha 2 (HBA2) mRNA
gcuggagccucgguagccguuccuccugcccgcugggccucccaacgggcccuccuccccuccuugcaccggcccuuccuggucuuugaauaaagucugagugggcag

SEQ ID NO: 3196 - DNA, 132 bp, Artificial Sequence
  3-UTR of Homo sapiens hemoglobin, beta (HBB)
gctcgctttcttgctgtccaatttctattaaaggttcctttgttccctaagtccaactactaaactgggggatattatgaagggccttgagcatctggattctgcctaataaaaaacatttattttcattgc

SEQ ID NO: 3197 - RNA, 132 nt, Artificial Sequence
  3-UTR of Homo sapiens hemoglobin, beta (HBB) mRNA
gcucgcuuucuugcuguccaauuucuauuaaagguuccuuuguucccuaaguccaacuacuaaacugggggauauuaugaagggccuugagcaucuggauucugccuaauaaaaaacauuuauuuucauugc

SEQ ID NO: 3198 - DNA, 44 bp, Artificial Sequence
  Center, alpha-complex-binding portion of the 3UTR of an alpha-globin gene (muag)
gcccgatgggcctcccaacgggccctcctcccctccttgcaccg

SEQ ID NO: 3199 - RNA, 44 nt, Artificial Sequence
  Center, alpha-complex-binding portion of the 3UTR of an alpha-globin gene (muag) mRNA
gcccgaugggccucccaacgggcccuccuccccuccuugcaccg

SEQ ID NO: 3200 - DNA, 186 bp, Artificial Sequence
  3-UTR of human albumin
catcacatttaaaagcatctcagcctaccatgagaataagagaaagaaaatgaagatcaaaagcttattcatctgtttttctttttcgttggtgtaaagccaacaccctgtctaaaaaacataaatttctttaatcattttgcctcttttctctgtgcttcaattaataaaaaatggaaagaatct

SEQ ID NO: 3201 - RNA, 186 nt, Artificial Sequence
  3-UTR of human albumin mRNA
caucacauuuaaaagcaucucagccuaccaugagaauaagagaaagaaaaugaagaucaaaagcuuauucaucuguuuuucuuuuucguugguguaaagccaacacccugucuaaaaaacauaaauuucuuuaaucauuuugccucuuuucucugugcuucaauuaauaaaaaauggaaagaaucu

SEQ ID NO: 3202 - DNA, 186 bp, Artificial Sequence
  3-UTR albumin7
catcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacct

SEQ ID NO: 3203 - RNA, 186 nt, Artificial Sequence
  3-UTR albumin7 mRNA
caucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccu

SEQ ID NO: 3204 - DNA, 187 bp, Artificial Sequence
  3-UTR ALB7
gcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacct

SEQ ID NO: 3205 - RNA, 187 nt, Artificial Sequence
  3-UTR ALB7 mRNA
gcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccu

SEQ ID NO: 3206 - DNA, 24 bp, Artificial Sequence
  histone stem-loop sequence
caaaggctcttttcagagccacca

SEQ ID NO: 3207 - RNA, 24 nt, Artificial Sequence
  histone stem-loop sequence mRNA
caaaggcucuuuucagagccacca

SEQ ID NO: 3208 - DNA, 13 bp, Artificial Sequence
  Kozak
gccgccaccatgg

SEQ ID NO: 3209 - RNA, 13 nt, Artificial Sequence
  Kozak mRNA
gccgccaccaugg

SEQ ID NO: 3210 - protein, 240 aa, Artificial Sequence
  VP8* aa2-240 long P[6]-Variant w/o glyco
MASLIYRQLLTNSYTVELSDEINTIGSEKNQQVTINPGPFAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGLPPMQNTRQIVPVALSSR

SEQ ID NO: 3211 - protein, 260 aa, Artificial Sequence
  VP8* aa2-240 long P[6]-Variant P2+Linker w/o glyco
MQYIKANSKFIGITELGSGSGASLIYRQLLTNSYTVELSDEINTIGSEKNQQVTINPGPFAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGLPPMQNTRQIVPVALSSR

SEQ ID NO: 3212 - protein, 260 aa, Artificial Sequence
  VP8* aa2-240 long P[6]-Variant SP(TPA) w/o glyco
MDAMKRGLCCVLLLCGAVFVSASLIYRQLLTNSYTVELSDEINTIGSEKNQQVTINPGPFAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGLPPMQNTRQIVPVALSSR

SEQ ID NO: 3213 - protein, 257 aa, Artificial Sequence
  VP8* aa2-240 long P[6]-Variant SP(HSA) w/o glyco
MKWVTFISLLFLFSSAYSASLIYRQLLTNSYTVELSDEINTIGSEKNQQVTINPGPFAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGLPPMQNTRQIVPVALSSR

SEQ ID NO: 3214 - protein, 257 aa, Artificial Sequence
  VP8* aa2-240 long P[6]-Variant SP(IgE) w/o glyco
MDWTWILFLVAAATRVHSASLIYRQLLTNSYTVELSDEINTIGSEKNQQVTINPGPFAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGLPPMQNTRQIVPVALSSR

SEQ ID NO: 3215 - protein, 263 aa, Artificial Sequence
  VP8* aa2-240 long P[6]-Variant SP(CD5) w/o glyco
MPMGSLQPLATLYLLGMLVASCLGASLIYRQLLTNSYTVELSDEINTIGSEKNQQVTINPGPFAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGLPPMQNTRQIVPVALSSR

SEQ ID NO: 3216 - protein, 263 aa, Artificial Sequence
  VP8* aa2-240 long P[6]-Variant SP(HLA-A2) w/o glyco
MAVMAPRTLVLLLSGALALTQTWAASLIYRQLLTNSYTVELSDEINTIGSEKNQQVTINPGPFAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGLPPMQNTRQIVPVALSSR

SEQ ID NO: 3217 - protein, 280 aa, Artificial Sequence
  VP8* aa2-240 long P[6]-Variant SP(TPA)+P2+Linker w/o glyco
MDAMKRGLCCVLLLCGAVFVSQYIKANSKFIGITELGSGSGASLIYRQLLTNSYTVELSDEINTIGSEKNQQVTINPGPFAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGLPPMQNTRQIVPVALSSR

SEQ ID NO: 3218 - protein, 277 aa, Artificial Sequence
  VP8* aa2-240 long P[6]-Variant SP(HSA)+P2+Linker w/o glyco
MKWVTFISLLFLFSSAYSQYIKANSKFIGITELGSGSGASLIYRQLLTNSYTVELSDEINTIGSEKNQQVTINPGPFAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGLPPMQNTRQIVPVALSSR

SEQ ID NO: 3219 - protein, 277 aa, Artificial Sequence
  VP8* aa2-240 long P[6]-Variant SP(IgE)+P2+Linker w/o glyco
MDWTWILFLVAAATRVHSQYIKANSKFIGITELGSGSGASLIYRQLLTNSYTVELSDEINTIGSEKNQQVTINPGPFAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGLPPMQNTRQIVPVALSSR

SEQ ID NO: 3220 - protein, 283 aa, Artificial Sequence
  VP8* aa2-240 long P[6]-Variant SP(CD5)+P2+Linker w/o glyco
MPMGSLQPLATLYLLGMLVASCLGQYIKANSKFIGITELGSGSGASLIYRQLLTNSYTVELSDEINTIGSEKNQQVTINPGPFAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGLPPMQNTRQIVPVALSSR

SEQ ID NO: 3221 - protein, 283 aa, Artificial Sequence
  VP8* aa2-240 long P[6]-Variant SP(HLA-A2)+P2+Linker w/o glyco
MAVMAPRTLVLLLSGALALTQTWAQYIKANSKFIGITELGSGSGASLIYRQLLTNSYTVELSDEINTIGSEKNQQVTINPGPFAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGLPPMQNTRQIVPVALSSR

SEQ ID NO: 3222 - protein, 230 aa, Artificial Sequence; identical to SEQ ID NO: 222
  VP8* aa2-230 P[6]-Variant w/o glyco

SEQ ID NO: 3223 - protein, 250 aa, Artificial Sequence; identical to SEQ ID NO: 226
  VP8* aa2-230 P[6]-Variant P2+Linker w/o glyco

SEQ ID NO: 3224 - protein, 250 aa, Artificial Sequence; identical to SEQ ID NO: 230
  VP8* aa2-230 P[6]-Variant SP(TPA) w/o glyco

SEQ ID NO: 3225 - protein, 247 aa, Artificial Sequence; identical to SEQ ID NO: 234
  VP8* aa2-230 P[6]-Variant SP(HSA) w/o glyco

SEQ ID NO: 3226 - protein, 247 aa, Artificial Sequence; identical to SEQ ID NO: 238
  VP8* aa2-230 P[6]-Variant SP(IgE) w/o glyco

SEQ ID NO: 3227 - protein, 253 aa, Artificial Sequence; identical to SEQ ID NO: 242
  VP8* aa2-230 P[6]-Variant SP(CD5) w/o glyco

SEQ ID NO: 3228 - protein, 253 aa, Artificial Sequence; identical to SEQ ID NO: 246
  VP8* aa2-230 P[6]-Variant SP(HLA-A2) w/o glyco

SEQ ID NO: 3229 - protein, 270 aa, Artificial Sequence; identical to SEQ ID NO: 250
  VP8* aa2-230 P[6]-Variant SP(TPA)+P2+Linker w/o glyco

SEQ ID NO: 3230 - protein, 267 aa, Artificial Sequence; identical to SEQ ID NO: 254
  VP8* aa2-230 P[6]-Variant SP(HSA)+P2+Linker w/o glyco

SEQ ID NO: 3231 - protein, 267 aa, Artificial Sequence; identical to SEQ ID NO: 258
  VP8* aa2-230 P[6]-Variant SP(IgE)+P2+Linker w/o glyco

SEQ ID NO: 3232 - protein, 273 aa, Artificial Sequence; identical to SEQ ID NO: 262
  VP8* aa2-230 P[6]-Variant SP(CD5)+P2+Linker w/o glyco

SEQ ID NO: 3233 - protein, 273 aa, Artificial Sequence; identical to SEQ ID NO: 266
  VP8* aa2-230 P[6]-Variant SP(HLA-A2)+P2+Linker w/o glyco

SEQ ID NO: 3234 - protein, 214 aa, Artificial Sequence; identical to SEQ ID NO: 318
  VP8* aa11-223 P[6]-Variant w/o glyco

SEQ ID NO: 3235 - protein, 234 aa, Artificial Sequence; identical to SEQ ID NO: 322
  VP8* aa11-223 P[6]-Variant P2+Linker w/o glyco

SEQ ID NO: 3236 - protein, 234 aa, Artificial Sequence; identical to SEQ ID NO: 326
  VP8* aa11-223 P[6]-Variant SP(TPA) w/o glyco

SEQ ID NO: 3237 - protein, 231 aa, Artificial Sequence; identical to SEQ ID NO: 330
  VP8* aa11-223 P[6]-Variant SP(HSA) w/o glyco

SEQ ID NO: 3238 - protein, 231 aa, Artificial Sequence; identical to SEQ ID NO: 334
  VP8* aa11-223 P[6]-Variant SP(IgE) w/o glyco

SEQ ID NO: 3239 - protein, 237 aa, Artificial Sequence; identical to SEQ ID NO: 338
  VP8* aa11-223 P[6]-Variant SP(CD5) w/o glyco

SEQ ID NO: 3240 - protein, 237 aa, Artificial Sequence; identical to SEQ ID NO: 342
  VP8* aa11-223 P[6]-Variant SP(HLA-A2) w/o glyco

SEQ ID NO: 3241 - protein, 254 aa, Artificial Sequence; identical to SEQ ID NO: 346
  VP8* aa11-223 P[6]-Variant SP(TPA)+P2+Linker w/o glyco

SEQ ID NO: 3242 - protein, 251 aa, Artificial Sequence; identical to SEQ ID NO: 350
  VP8* aa11-223 P[6]-Variant SP(HSA)+P2+Linker w/o glyco

SEQ ID NO: 3243 - protein, 251 aa, Artificial Sequence; identical to SEQ ID NO: 354
  VP8* aa11-223 P[6]-Variant SP(IgE)+P2+Linker w/o glyco

SEQ ID NO: 3244 - protein, 257 aa, Artificial Sequence; identical to SEQ ID NO: 358
  VP8* aa11-223 P[6]-Variant SP(CD5)+P2+Linker w/o glyco

SEQ ID NO: 3245 - protein, 257 aa, Artificial Sequence; identical to SEQ ID NO: 362
  VP8* aa11-223 P[6]-Variant SP(HLA-A2)+P2+Linker w/o glyco

SEQ ID NO: 3246 - protein, 231 aa, Artificial Sequence
  VP8* aa11-240 P[6]-Variant w/o glyco
MTNSYTVELSDEINTIGSEKNQQVTINPGPFAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGLPPMQNTRQIVPVALSSR

SEQ ID NO: 3247 - protein, 251 aa, Artificial Sequence
  VP8* aa11-240 P[6]-Variant P2+Linker w/o glyco
MQYIKANSKFIGITELGSGSGTNSYTVELSDEINTIGSEKNQQVTINPGPFAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGLPPMQNTRQIVPVALSSR

SEQ ID NO: 3248 - protein, 251 aa, Artificial Sequence
  VP8* aa11-240 P[6]-Variant SP(TPA) w/o glyco
MDAMKRGLCCVLLLCGAVFVSTNSYTVELSDEINTIGSEKNQQVTINPGPFAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGLPPMQNTRQIVPVALSSR

SEQ ID NO: 3249 - protein, 248 aa, Artificial Sequence
  VP8* aa11-240 P[6]-Variant SP(HSA) w/o glyco
MKWVTFISLLFLFSSAYSTNSYTVELSDEINTIGSEKNQQVTINPGPFAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGLPPMQNTRQIVPVALSSR

SEQ ID NO: 3250 - protein, 248 aa, Artificial Sequence
  VP8* aa11-240 P[6]-Variant SP(IgE) w/o glyco
MDWTWILFLVAAATRVHSTNSYTVELSDEINTIGSEKNQQVTINPGPFAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGLPPMQNTRQIVPVALSSR

SEQ ID NO: 3251 - protein, 254 aa, Artificial Sequence
  VP8* aa11-240 P[6]-Variant SP(CD5) w/o glyco
MPMGSLQPLATLYLLGMLVASCLGTNSYTVELSDEINTIGSEKNQQVTINPGPFAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGLPPMQNTRQIVPVALSSR

SEQ ID NO: 3252 - protein, 254 aa, Artificial Sequence
  VP8* aa11-240 P[6]-Variant SP(HLA-A2) w/o glyco
MAVMAPRTLVLLLSGALALTQTWATNSYTVELSDEINTIGSEKNQQVTINPGPFAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGLPPMQNTRQIVPVALSSR

SEQ ID NO: 3253 - protein, 271 aa, Artificial Sequence
  VP8* aa11-240 P[6]-Variant SP(TPA)+P2+Linker w/o glyco
MDAMKRGLCCVLLLCGAVFVSQYIKANSKFIGITELGSGSGTNSYTVELSDEINTIGSEKNQQVTINPGPFAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGLPPMQNTRQIVPVALSSR

SEQ ID NO: 3254 - protein, 268 aa, Artificial Sequence
  VP8* aa11-240 P[6]-Variant SP(HSA)+P2+Linker w/o glyco
MKWVTFISLLFLFSSAYSQYIKANSKFIGITELGSGSGTNSYTVELSDEINTIGSEKNQQVTINPGPFAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGLPPMQNTRQIVPVALSSR

SEQ ID NO: 3255 - protein, 268 aa, Artificial Sequence
  VP8* aa11-240 P[6]-Variant SP(IgE)+P2+Linker w/o glyco
MDWTWILFLVAAATRVHSQYIKANSKFIGITELGSGSGTNSYTVELSDEINTIGSEKNQQVTINPGPFAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGLPPMQNTRQIVPVALSSR

SEQ ID NO: 3256 - protein, 274 aa, Artificial Sequence
  VP8* aa11-240 P[6]-Variant SP(CD5)+P2+Linker w/o glyco
MPMGSLQPLATLYLLGMLVASCLGQYIKANSKFIGITELGSGSGTNSYTVELSDEINTIGSEKNQQVTINPGPFAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGLPPMQNTRQIVPVALSSR

SEQ ID NO: 3257 - protein, 274 aa, Artificial Sequence
  VP8* aa11-240 P[6]-Variant SP(HLA-A2)+P2+Linker w/o glyco
MAVMAPRTLVLLLSGALALTQTWAQYIKANSKFIGITELGSGSGTNSYTVELSDEINTIGSEKNQQVTINPGPFAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGLPPMQNTRQIVPVALSSR

SEQ ID NO: 3258 - protein, 221 aa, Artificial Sequence
  VP8* aa21-240 P[6]-Variant w/o glyco
MEINTIGSEKNQQVTINPGPFAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGLPPMQNTRQIVPVALSSR

SEQ ID NO: 3259 - protein, 241 aa, Artificial Sequence
  VP8* aa21-240 P[6]-Variant P2+Linker w/o glyco
MQYIKANSKFIGITELGSGSGEINTIGSEKNQQVTINPGPFAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGLPPMQNTRQIVPVALSSR

SEQ ID NO: 3260 - protein, 241 aa, Artificial Sequence
  VP8* aa21-240 P[6]-Variant SP(TPA) w/o glyco
MDAMKRGLCCVLLLCGAVFVSEINTIGSEKNQQVTINPGPFAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGLPPMQNTRQIVPVALSSR

SEQ ID NO: 3261 - protein, 238 aa, Artificial Sequence
  VP8* aa21-240 P[6]-Variant SP(HSA) w/o glyco
MKWVTFISLLFLFSSAYSEINTIGSEKNQQVTINPGPFAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGLPPMQNTRQIVPVALSSR

SEQ ID NO: 3262 - protein, 238 aa, Artificial Sequence
  VP8* aa21-240 P[6]-Variant SP(IgE) w/o glyco
MDWTWILFLVAAATRVHSEINTIGSEKNQQVTINPGPFAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGLPPMQNTRQIVPVALSSR

SEQ ID NO: 3263 - protein, 244 aa, Artificial Sequence
  VP8* aa21-240 P[6]-Variant SP(CD5) w/o glyco
MPMGSLQPLATLYLLGMLVASCLGEINTIGSEKNQQVTINPGPFAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGLPPMQNTRQIVPVALSSR

SEQ ID NO: 3264 - protein, 244 aa, Artificial Sequence
  VP8* aa21-240 P[6]-Variant SP(HLA-A2) w/o glyco
MAVMAPRTLVLLLSGALALTQTWAEINTIGSEKNQQVTINPGPFAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGLPPMQNTRQIVPVALSSR

SEQ ID NO: 3265 - protein, 261 aa, Artificial Sequence
  VP8* aa21-240 P[6]-Variant SP(TPA)+P2+Linker w/o glyco
MDAMKRGLCCVLLLCGAVFVSQYIKANSKFIGITELGSGSGEINTIGSEKNQQVTINPGPFAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGLPPMQNTRQIVPVALSSR

SEQ ID NO: 3266 - protein, 258 aa, Artificial Sequence
  VP8* aa21-240 P[6]-Variant SP(HSA)+P2+Linker w/o glyco
MKWVTFISLLFLFSSAYSQYIKANSKFIGITELGSGSGEINTIGSEKNQQVTINPGPFAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGLPPMQNTRQIVPVALSSR

SEQ ID NO: 3267 - protein, 258 aa, Artificial Sequence
  VP8* aa21-240 P[6]-Variant SP(IgE)+P2+Linker w/o glyco
MDWTWILFLVAAATRVHSQYIKANSKFIGITELGSGSGEINTIGSEKNQQVTINPGPFAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGLPPMQNTRQIVPVALSSR

SEQ ID NO: 3268 - protein, 264 aa, Artificial Sequence
  VP8* aa21-240 P[6]-Variant SP(CD5)+P2+Linker w/o glyco
MPMGSLQPLATLYLLGMLVASCLGQYIKANSKFIGITELGSGSGEINTIGSEKNQQVTINPGPFAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGLPPMQNTRQIVPVALSSR

SEQ ID NO: 3269 - protein, 264 aa, Artificial Sequence
  VP8* aa21-240 P[6]-Variant SP(HLA-A2)+P2+Linker w/o glyco
MAVMAPRTLVLLLSGALALTQTWAQYIKANSKFIGITELGSGSGEINTIGSEKNQQVTINPGPFAQTNYAPVTWSHGEVQDSTTIEPVLDGPYQPTNFKPPNDYWILLNPTNQQVVLEGTQKTDIWVALLLVEPQVTQQSRQYTLFGETKQITVEQNTNKWKFFEMFRSSVSAEFQHKRTLTSDTKLAGFMKFYQSVWTFHGETPQATTDYSSTSNLFEVETVIHVEFYIIPRSQESKCSEYINTGLPPMQNTRQIVPVALSSR

SEQ ID NO: 3270 - protein, 184 aa, Artificial Sequence; identical to SEQ ID NO: 606
  VP8* aa41-223P[6]-Variant w/o glyco

SEQ ID NO: 3271 - protein, 204 aa, Artificial Sequence; identical to SEQ ID NO: 610
  VP8* aa41-223P[6]-Variant P2+Linker w/o glyco

SEQ ID NO: 3272 - protein, 204 aa, Artificial Sequence; identical to SEQ ID NO: 614
  VP8* aa41-223P[6]-Variant SP(TPA) w/o glyco

SEQ ID NO: 3273 - protein, 201 aa, Artificial Sequence; identical to SEQ ID NO: 618
  VP8* aa41-223P[6]-Variant SP(HSA) w/o glyco

SEQ ID NO: 3274 - protein, 201 aa, Artificial Sequence; identical to SEQ ID NO: 622
  VP8* aa41-223P[6]-Variant SP(IgE) w/o glyco

SEQ ID NO: 3275 - protein, 207 aa, Artificial Sequence; identical to SEQ ID NO: 626
  VP8* aa41-223P[6]-Variant SP(CD5) w/o glyco

SEQ ID NO: 3276 - protein, 207 aa, Artificial Sequence; identical to SEQ ID NO: 630
  VP8* aa41-223P[6]-Variant SP(HLA-A2) w/o glyco

SEQ ID NO: 3277 - protein, 224 aa, Artificial Sequence; identical to SEQ ID NO: 634
  VP8* aa41-223P[6]-Variant SP(TPA)+P2+Linker w/o glyco

SEQ ID NO: 3278 - protein, 221 aa, Artificial Sequence; identical to SEQ ID NO: 638
  VP8* aa41-223P[6]-Variant SP(HSA)+P2+Linker w/o glyco

SEQ ID NO: 3279 - protein, 221 aa, Artificial Sequence; identical to SEQ ID NO: 642
  VP8* aa41-223P[6]-Variant SP(IgE)+P2+Linker w/o glyco

SEQ ID NO: 3280 - protein, 227 aa, Artificial Sequence; identical to SEQ ID NO: 646
  VP8* aa41-223P[6]-Variant SP(CD5)+P2+Linker w/o glyco

SEQ ID NO: 3281 - protein, 227 aa, Artificial Sequence; identical to SEQ ID NO: 650
  VP8* aa41-223 P[6]-Variant SP(HLA-A2)+P2+Linker w/o glyco

SEQ ID NO: 3282 - protein, 160 aa, Artificial Sequence; identical to SEQ ID NO: 702
  VP8* aa65-223 short P[6]-Variant w/o glyco

SEQ ID NO: 3283 - protein, 180 aa, Artificial Sequence; identical to SEQ ID NO: 706
  VP8* aa65-223 short P[6]-Variant P2+Linker w/o glyco

SEQ ID NO: 3284 - protein, 180 aa, Artificial Sequence; identical to SEQ ID NO: 710
  VP8* aa65-223 short P[6]-Variant SP(TPA) w/o glyco

SEQ ID NO: 3285 - protein, 177 aa, Artificial Sequence; identical to SEQ ID NO: 714
  VP8* aa65-223 short P[6]-Variant SP(HSA) w/o glyco

SEQ ID NO: 3286 - protein, 177 aa, Artificial Sequence; identical to SEQ ID NO: 718
  VP8* aa65-223 short P[6]-Variant SP(IgE) w/o glyco

SEQ ID NO: 3287 - protein, 183 aa, Artificial Sequence; identical to SEQ ID NO: 722
  VP8* aa65-223 short P[6]-Variant SP(CD5) w/o glyco

SEQ ID NO: 3288 - protein, 183 aa, Artificial Sequence; identical to SEQ ID NO: 726
  VP8* aa65-223 short P[6]-Variant SP(HLA-A2) w/o glyco

SEQ ID NO: 3289 - protein, 200 aa, Artificial Sequence; identical to SEQ ID NO: 730
  VP8* aa65-223 short P[6]-Variant SP(TPA)+P2+Linker w/o glyco

SEQ ID NO: 3290 - protein, 197 aa, Artificial Sequence; identical to SEQ ID NO: 734
  VP8* aa65-223 short P[6]-Variant SP(HSA)+P2+Linker w/o glyco

SEQ ID NO: 3291 - protein, 197 aa, Artificial Sequence; identical to SEQ ID NO: 738
  VP8* aa65-223 short P[6]-Variant SP(IgE)+P2+Linker w/o glyco

SEQ ID NO: 3292 - protein, 203 aa, Artificial Sequence; identical to SEQ ID NO: 742
  VP8* aa65-223 short P[6]-Variant SP(CD5)+P2+Linker w/o glyco

SEQ ID NO: 3293 - protein, 203 aa, Artificial Sequence; identical to SEQ ID NO: 746
  VP8* aa65-223 short P[6]-Variant SP(HLA-A2)+P2+Linker w/o glyco

SEQ ID NO: 3294 - protein, 160 aa, Artificial Sequence; identical to SEQ ID NO: 702
  VP8* aa64-223 short P[6]-Variant w/o glyco

SEQ ID NO: 3295 - protein, 181 aa, Artificial Sequence; identical to SEQ ID NO: 776
  VP8* aa64-223 short P[6]-Variant P2+Linker w/o glyco

SEQ ID NO: 3296 - protein, 181 aa, Artificial Sequence; identical to SEQ ID NO: 778
  VP8* aa64-223 short P[6]-Variant SP(TPA) w/o glyco

SEQ ID NO: 3297 - protein, 178 aa, Artificial Sequence; identical to SEQ ID NO: 780
  VP8* aa64-223 short P[6]-Variant SP(HSA) w/o glyco

SEQ ID NO: 3298 - protein, 178 aa, Artificial Sequence; identical to SEQ ID NO: 782
  VP8* aa64-223 short P[6]-Variant SP(IgE) w/o glyco

SEQ ID NO: 3299 - protein, 184 aa, Artificial Sequence; identical to SEQ ID NO: 784
  VP8* aa64-223 short P[6]-Variant SP(CD5) w/o glyco

SEQ ID NO: 3300 - protein, 184 aa, Artificial Sequence; identical to SEQ ID NO: 786
  VP8* aa64-223 short P[6]-Variant SP(HLA-A2) w/o glyco

SEQ ID NO: 3301 - protein, 201 aa, Artificial Sequence; identical to SEQ ID NO: 788
  VP8* aa64-223 short P[6]-Variant SP(TPA)+P2+Linker w/o glyco

SEQ ID NO: 3302 - protein, 198 aa, Artificial Sequence; identical to SEQ ID NO: 790
  VP8* aa64-223 short P[6]-Variant SP(HSA)+P2+Linker w/o glyco

SEQ ID NO: 3303 - protein, 198 aa, Artificial Sequence; identical to SEQ ID NO: 792
  VP8* aa64-223 short P[6]-Variant SP(IgE)+P2+Linker w/o glyco

SEQ ID NO: 3304 - protein, 204 aa, Artificial Sequence; identical to SEQ ID NO: 794
  VP8* aa64-223 short P[6]-Variant SP(CD5)+P2+Linker w/o glyco

SEQ ID NO: 3305 - protein, 204 aa, Artificial Sequence; identical to SEQ ID NO: 796
  VP8* aa64-223 short P[6]-Variant SP(HLA-A2)+P2+Linker w/o glyco

SEQ ID NO: 3306 - RNA, 723 nt, Artificial Sequence
  VP8* aa2-240 long P[6]-Variant w/o glyco CDS opt
auggccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcuga

SEQ ID NO: 3307 - RNA, 783 nt, Artificial Sequence
  VP8* aa2-240 long P[6]-Variant P2+Linker w/o glyco CDS opt
augcaguacaucaaggccaacagcaaguucaucggcaucaccgagcugggcagcggguccggcgccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcuga

SEQ ID NO: 3308 - RNA, 783 nt, Artificial Sequence
  VP8* aa2-240 long P[6]-Variant SP(TPA) w/o glyco CDS opt
auggacgccaugaagcgcggccugugcugcgugcuccugcugugcggggccgucuucgugagcgccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcuga

SEQ ID NO: 3309 - RNA, 774 nt, Artificial Sequence
  VP8* aa2-240 long P[6]-Variant SP(HSA) w/o glyco CDS opt
augaagugggugaccuucaucagccugcucuuccuguucuccagcgccuacuccgccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcuga

SEQ ID NO: 3310 - RNA, 774 nt, Artificial Sequence
  VP8* aa2-240 long P[6]-Variant SP(IgE) w/o glyco CDS opt
auggacuggaccuggauccuguuccucguggccgccgcgacccgcguccacagcgccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcuga

SEQ ID NO: 3311 - RNA, 792 nt, Artificial Sequence
  VP8* aa2-240 long P[6]-Variant SP(CD5) w/o glyco CDS opt
augcccaugggcagccugcagccgcucgccacccuguaccugcucgggaugcugguggccuccugccugggcgccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcuga

SEQ ID NO: 3312 - RNA, 792 nt, Artificial Sequence
  VP8* aa2-240 long P[6]-Variant SP(HLA-A2) w/o glyco CDS opt
auggccgugauggccccgcggacccugguccuccugcugagcggcgcgcucgcccugacccagacgugggccgccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcuga

SEQ ID NO: 3313 - RNA, 843 nt, Artificial Sequence
  VP8* aa2-240 long P[6]-Variant SP(TPA)+P2+Linker w/o glyco CDS opt
auggacgccaugaagcgcggccugugcugcgugcuccugcugugcggggccgucuucgugagccaguacaucaaggccaacagcaaguucaucggcaucaccgagcugggcagcggguccggcgccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcuga

SEQ ID NO: 3314 - RNA, 834 nt, Artificial Sequence
  VP8* aa2-240 long P[6]-Variant SP(HSA)+P2+Linker w/o glyco CDS opt
augaagugggugaccuucaucagccugcucuuccuguucuccagcgccuacucccaguacaucaaggccaacagcaaguucaucggcaucaccgagcugggcagcggguccggcgccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcuga

SEQ ID NO: 3315 - RNA, 834 nt, Artificial Sequence
  VP8* aa2-240 long P[6]-Variant SP(IgE)+P2+Linker w/o glyco CDS opt
auggacuggaccuggauccuguuccucguggccgccgcgacccgcguccacagccaguacaucaaggccaacagcaaguucaucggcaucaccgagcugggcagcggguccggcgccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcuga

SEQ ID NO: 3316 - RNA, 852 nt, Artificial Sequence
  VP8* aa2-240 long P[6]-Variant SP(CD5)+P2+Linker w/o glyco CDS opt
augcccaugggcagccugcagccgcucgccacccuguaccugcucgggaugcugguggccuccugccugggccaguacaucaaggccaacagcaaguucaucggcaucaccgagcugggcagcggguccggcgccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcuga

SEQ ID NO: 3317 - RNA, 852 nt, Artificial Sequence
  VP8* aa2-240 long P[6]-Variant SP(HLA-A2)+P2+Linker w/o glyco CDS opt
auggccgugauggccccgcggacccugguccuccugcugagcggcgcgcucgcccugacccagacgugggcccaguacaucaaggccaacagcaaguucaucggcaucaccgagcugggcagcggguccggcgccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcuga

SEQ ID NO: 3318 - RNA, 693 nt, Artificial Sequence; identical to SEQ ID NO: 1023
  VP8* aa2-230 P[6]-Variant w/o glyco CDS opt

SEQ ID NO: 3319 - RNA, 753 nt, Artificial Sequence; identical to SEQ ID NO: 1027
  VP8* aa2-230 P[6]-Variant P2+Linker w/o glyco CDS opt

SEQ ID NO: 3320 - RNA, 753 nt, Artificial Sequence; identical to SEQ ID NO: 1031
  VP8* aa2-230 P[6]-Variant SP(TPA) w/o glyco CDS opt

SEQ ID NO: 3321 - RNA, 744 nt, Artificial Sequence; identical to SEQ ID NO: 1035
  VP8* aa2-230 P[6]-Variant SP(HSA) w/o glyco CDS opt

SEQ ID NO: 3322 - RNA, 744 nt, Artificial Sequence; identical to SEQ ID NO: 1039
  VP8* aa2-230 P[6]-Variant SP(IgE) w/o glyco CDS opt

SEQ ID NO: 3323 - RNA, 762 nt, Artificial Sequence; identical to SEQ ID NO: 1043
  VP8* aa2-230 P[6]-Variant SP(CD5) w/o glyco CDS opt

SEQ ID NO: 3324 - RNA, 762 nt, Artificial Sequence; identical to SEQ ID NO: 1047
  VP8* aa2-230 P[6]-Variant SP(HLA-A2) w/o glyco CDS opt

SEQ ID NO: 3325 - RNA, 813 nt, Artificial Sequence; identical to SEQ ID NO: 1051
  VP8* aa2-230 P[6]-Variant SP(TPA)+P2+Linker w/o glyco CDS opt

SEQ ID NO: 3326 - RNA, 804 nt, Artificial Sequence; identical to SEQ ID NO: 1055
  VP8* aa2-230 P[6]-Variant SP(HSA)+P2+Linker w/o glyco CDS opt

SEQ ID NO: 3327 - RNA, 804 nt, Artificial Sequence; identical to SEQ ID NO: 1059
  VP8* aa2-230 P[6]-Variant SP(IgE)+P2+Linker w/o glyco CDS opt

SEQ ID NO: 3328 - RNA, 822 nt, Artificial Sequence; identical to SEQ ID NO: 1063
  VP8* aa2-230 P[6]-Variant SP(CD5)+P2+Linker w/o glyco CDS opt

SEQ ID NO: 3329 - RNA, 822 nt, Artificial Sequence; identical to SEQ ID NO: 1067
  VP8* aa2-230 P[6]-Variant SP(HLA-A2)+P2+Linker w/o glyco CDS opt

SEQ ID NO: 3330 - RNA, 645 nt, Artificial Sequence; identical to SEQ ID NO: 1119
  VP8* aa11-223 P[6]-Variant w/o glyco CDS opt

SEQ ID NO: 3331 - RNA, 705 nt, Artificial Sequence; identical to SEQ ID NO: 1123
  VP8* aa11-223 P[6]-Variant P2+Linker w/o glyco CDS opt

SEQ ID NO: 3332 - RNA, 705 nt, Artificial Sequence; identical to SEQ ID NO: 1127
  VP8* aa11-223 P[6]-Variant SP(TPA) w/o glyco CDS opt

SEQ ID NO: 3333 - RNA, 696 nt, Artificial Sequence; identical to SEQ ID NO: 1131
  VP8* aa11-223 P[6]-Variant SP(HSA) w/o glyco CDS opt

SEQ ID NO: 3334 - RNA, 696 nt, Artificial Sequence; identical to SEQ ID NO: 1135
  VP8* aa11-223 P[6]-Variant SP(IgE) w/o glyco CDS opt

SEQ ID NO: 3335 - RNA, 714 nt, Artificial Sequence; identical to SEQ ID NO: 1139
  VP8* aa11-223 P[6]-Variant SP(CD5) w/o glyco CDS opt

SEQ ID NO: 3336 - RNA, 714 nt, Artificial Sequence; identical to SEQ ID NO: 1143
  VP8* aa11-223 P[6]-Variant SP(HLA-A2) w/o glyco CDS opt

SEQ ID NO: 3337 - RNA, 765 nt, Artificial Sequence; identical to SEQ ID NO: 1147
  VP8* aa11-223 P[6]-Variant SP(TPA)+P2+Linker w/o glyco CDS opt

SEQ ID NO: 3338 - RNA, 756 nt, Artificial Sequence; identical to SEQ ID NO: 1151
  VP8* aa11-223 P[6]-Variant SP(HSA)+P2+Linker w/o glyco CDS opt

SEQ ID NO: 3339 - RNA, 756 nt, Artificial Sequence; identical to SEQ ID NO: 1155
  VP8* aa11-223 P[6]-Variant SP(IgE)+P2+Linker w/o glyco CDS opt

SEQ ID NO: 3340 - RNA, 774 nt, Artificial Sequence; identical to SEQ ID NO: 1159
  VP8* aa11-223 P[6]-Variant SP(CD5)+P2+Linker w/o glyco CDS opt

SEQ ID NO: 3341 - RNA, 774 nt, Artificial Sequence; identical to SEQ ID NO: 1163
  VP8* aa11-223 P[6]-Variant SP(HLA-A2)+P2+Linker w/o glyco CDS opt

SEQ ID NO: 3342 - RNA, 696 nt, Artificial Sequence
  VP8* aa11-240 P[6]-Variant w/o glyco CDS opt
augaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcuga

SEQ ID NO: 3343 - RNA, 756 nt, Artificial Sequence
  VP8* aa11-240 P[6]-Variant P2+Linker w/o glyco CDS opt
augcaguacaucaaggccaacagcaaguucaucggcaucaccgagcugggcagcggguccggcaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcuga

SEQ ID NO: 3344 - RNA, 756 nt, Artificial Sequence
  VP8* aa11-240 P[6]-Variant SP(TPA) w/o glyco CDS opt
auggacgccaugaagcgcggccugugcugcgugcuccugcugugcggggccgucuucgugagcaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcuga

SEQ ID NO: 3345 - RNA, 747 nt, Artificial Sequence
  VP8* aa11-240 P[6]-Variant SP(HSA) w/o glyco CDS opt
augaagugggugaccuucaucagccugcucuuccuguucuccagcgccuacuccaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcuga

SEQ ID NO: 3346 - RNA, 747 nt, Artificial Sequence
  VP8* aa11-240 P[6]-Variant SP(IgE) w/o glyco CDS opt
auggacuggaccuggauccuguuccucguggccgccgcgacccgcguccacagcaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcuga

SEQ ID NO: 3347 - RNA, 765 nt, Artificial Sequence
  VP8* aa11-240 P[6]-Variant SP(CD5) w/o glyco CDS opt
augcccaugggcagccugcagccgcucgccacccuguaccugcucgggaugcugguggccuccugccugggcaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcuga

SEQ ID NO: 3348 - RNA, 765 nt, Artificial Sequence
  VP8* aa11-240 P[6]-Variant SP(HLA-A2) w/o glyco CDS opt
auggccgugauggccccgcggacccugguccuccugcugagcggcgcgcucgcccugacccagacgugggccaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcuga

SEQ ID NO: 3349 - RNA, 816 nt, Artificial Sequence
  VP8* aa11-240 P[6]-Variant SP(TPA)+P2+Linker w/o glyco CDS opt
auggacgccaugaagcgcggccugugcugcgugcuccugcugugcggggccgucuucgugagccaguacaucaaggccaacagcaaguucaucggcaucaccgagcugggcagcggguccggcaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcuga

SEQ ID NO: 3350 - RNA, 807 nt, Artificial Sequence
  VP8* aa11-240 P[6]-Variant SP(HSA)+P2+Linker w/o glyco CDS opt
augaagugggugaccuucaucagccugcucuuccuguucuccagcgccuacucccaguacaucaaggccaacagcaaguucaucggcaucaccgagcugggcagcggguccggcaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcuga

SEQ ID NO: 3351 - RNA, 807 nt, Artificial Sequence
  VP8* aa11-240 P[6]-Variant SP(IgE)+P2+Linker w/o glyco CDS opt
auggacuggaccuggauccuguuccucguggccgccgcgacccgcguccacagccaguacaucaaggccaacagcaaguucaucggcaucaccgagcugggcagcggguccggcaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcuga

SEQ ID NO: 3352 - RNA, 825 nt, Artificial Sequence
  VP8* aa11-240 P[6]-Variant SP(CD5)+P2+Linker w/o glyco CDS opt
augcccaugggcagccugcagccgcucgccacccuguaccugcucgggaugcugguggccuccugccugggccaguacaucaaggccaacagcaaguucaucggcaucaccgagcugggcagcggguccggcaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcuga

SEQ ID NO: 3353 - RNA, 825 nt, Artificial Sequence
  VP8* aa11-240 P[6]-Variant SP(HLA-A2)+P2+Linker w/o glyco CDS opt
auggccgugauggccccgcggacccugguccuccugcugagcggcgcgcucgcccugacccagacgugggcccaguacaucaaggccaacagcaaguucaucggcaucaccgagcugggcagcggguccggcaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcuga

SEQ ID NO: 3354 - RNA, 666 nt, Artificial Sequence
  VP8* aa21-240 P[6]-Variant w/o glyco CDS opt
auggagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcuga

SEQ ID NO: 3355 - RNA, 726 nt, Artificial Sequence
  VP8* aa21-240 P[6]-Variant P2+Linker w/o glyco CDS opt
augcaguacaucaaggccaacagcaaguucaucggcaucaccgagcugggcagcggguccggcgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcuga

SEQ ID NO: 3356 - RNA, 726 nt, Artificial Sequence
  VP8* aa21-240 P[6]-Variant SP(TPA) w/o glyco CDS opt
auggacgccaugaagcgcggccugugcugcgugcuccugcugugcggggccgucuucgugagcgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcuga

SEQ ID NO: 3357 - RNA, 717 nt, Artificial Sequence
  VP8* aa21-240 P[6]-Variant SP(HSA) w/o glyco CDS opt
augaagugggugaccuucaucagccugcucuuccuguucuccagcgccuacuccgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcuga

SEQ ID NO: 3358 - RNA, 717 nt, Artificial Sequence
  VP8* aa21-240 P[6]-Variant SP(IgE) w/o glyco CDS opt
auggacuggaccuggauccuguuccucguggccgccgcgacccgcguccacagcgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcuga

SEQ ID NO: 3359 - RNA, 735 nt, Artificial Sequence
  VP8* aa21-240 P[6]-Variant SP(CD5) w/o glyco CDS opt
augcccaugggcagccugcagccgcucgccacccuguaccugcucgggaugcugguggccuccugccugggcgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcuga

SEQ ID NO: 3360 - RNA, 735 nt, Artificial Sequence
  VP8* aa21-240 P[6]-Variant SP(HLA-A2) w/o glyco CDS opt
auggccgugauggccccgcggacccugguccuccugcugagcggcgcgcucgcccugacccagacgugggccgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcuga

SEQ ID NO: 3361 - RNA, 786 nt, Artificial Sequence
  VP8* aa21-240 P[6]-Variant SP(TPA)+P2+Linker w/o glyco CDS opt
auggacgccaugaagcgcggccugugcugcgugcuccugcugugcggggccgucuucgugagccaguacaucaaggccaacagcaaguucaucggcaucaccgagcugggcagcggguccggcgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcuga

SEQ ID NO: 3362 - RNA, 777 nt, Artificial Sequence
  VP8* aa21-240 P[6]-Variant SP(HSA)+P2+Linker w/o glyco CDS opt
augaagugggugaccuucaucagccugcucuuccuguucuccagcgccuacucccaguacaucaaggccaacagcaaguucaucggcaucaccgagcugggcagcggguccggcgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcuga

SEQ ID NO: 3363 - RNA, 777 nt, Artificial Sequence
  VP8* aa21-240 P[6]-Variant SP(IgE)+P2+Linker w/o glyco CDS opt
auggacuggaccuggauccuguuccucguggccgccgcgacccgcguccacagccaguacaucaaggccaacagcaaguucaucggcaucaccgagcugggcagcggguccggcgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcuga

SEQ ID NO: 3364 - RNA, 795 nt, Artificial Sequence
  VP8* aa21-240 P[6]-Variant SP(CD5)+P2+Linker w/o glyco CDS opt
augcccaugggcagccugcagccgcucgccacccuguaccugcucgggaugcugguggccuccugccugggccaguacaucaaggccaacagcaaguucaucggcaucaccgagcugggcagcggguccggcgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcuga

SEQ ID NO: 3365 - RNA, 795 nt, Artificial Sequence
  VP8* aa21-240 P[6]-Variant SP(HLA-A2)+P2+Linker w/o glyco CDS opt
auggccgugauggccccgcggacccugguccuccugcugagcggcgcgcucgcccugacccagacgugggcccaguacaucaaggccaacagcaaguucaucggcaucaccgagcugggcagcggguccggcgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcuga

SEQ ID NO: 3366 - RNA, 555 nt, Artificial Sequence; identical to SEQ ID NO: 1407
  VP8* aa41-223P[6]-Variant w/o glyco CDS opt

SEQ ID NO: 3367 - RNA, 615 nt, Artificial Sequence; identical to SEQ ID NO: 1411
  VP8* aa41-223P[6]-Variant P2+Linker w/o glyco CDS opt

SEQ ID NO: 3368 - RNA, 615 nt, Artificial Sequence; identical to SEQ ID NO: 1415
  VP8* aa41-223P[6]-Variant SP(TPA) w/o glyco CDS opt

SEQ ID NO: 3369 - RNA, 606 nt, Artificial Sequence; identical to SEQ ID NO: 1419
  VP8* aa41-223P[6]-Variant SP(HSA) w/o glyco CDS opt

SEQ ID NO: 3370 - RNA, 606 nt, Artificial Sequence; identical to SEQ ID NO: 1423
  VP8* aa41-223P[6]-Variant SP(IgE) w/o glyco CDS opt

SEQ ID NO: 3371 - RNA, 624 nt, Artificial Sequence; identical to SEQ ID NO: 1427
  VP8* aa41-223P[6]-Variant SP(CD5) w/o glyco CDS opt

SEQ ID NO: 3372 - RNA, 624 nt, Artificial Sequence; identical to SEQ ID NO: 1431
  VP8* aa41-223P[6]-Variant SP(HLA-A2) w/o glyco CDS opt

SEQ ID NO: 3373 - RNA, 675 nt, Artificial Sequence; identical to SEQ ID NO: 1435
  VP8* aa41-223P[6]-Variant SP(TPA)+P2+Linker w/o glyco CDS opt

SEQ ID NO: 3374 - RNA, 666 nt, Artificial Sequence; identical to SEQ ID NO: 1439
  VP8* aa41-223P[6]-Variant SP(HSA)+P2+Linker w/o glyco CDS opt

SEQ ID NO: 3375 - RNA, 666 nt, Artificial Sequence; identical to SEQ ID NO: 1443
  VP8* aa41-223P[6]-Variant SP(IgE)+P2+Linker w/o glyco CDS opt

SEQ ID NO: 3376 - RNA, 684 nt, Artificial Sequence; identical to SEQ ID NO: 1447
  VP8* aa41-223P[6]-Variant SP(CD5)+P2+Linker w/o glyco CDS opt

SEQ ID NO: 3377 - RNA, 684 nt, Artificial Sequence; identical to SEQ ID NO: 1451
  VP8* aa41-223 P[6]-Variant SP(HLA-A2)+P2+Linker w/o glyco CDS opt

SEQ ID NO: 3378 - RNA, 483 nt, Artificial Sequence; identical to SEQ ID NO: 1503
  VP8* aa65-223 short P[6]-Variant w/o glyco CDS opt

SEQ ID NO: 3379 - RNA, 543 nt, Artificial Sequence; identical to SEQ ID NO: 1507
  VP8* aa65-223 short P[6]-Variant P2+Linker w/o glyco CDS opt

SEQ ID NO: 3380 - RNA, 543 nt, Artificial Sequence; identical to SEQ ID NO: 1511
  VP8* aa65-223 short P[6]-Variant SP(TPA) w/o glyco CDS opt

SEQ ID NO: 3381 - RNA, 534 nt, Artificial Sequence; identical to SEQ ID NO: 1515
  VP8* aa65-223 short P[6]-Variant SP(HSA) w/o glyco CDS opt

SEQ ID NO: 3382 - RNA, 534 nt, Artificial Sequence; identical to SEQ ID NO: 1519
  VP8* aa65-223 short P[6]-Variant SP(IgE) w/o glyco CDS opt

SEQ ID NO: 3383 - RNA, 552 nt, Artificial Sequence; identical to SEQ ID NO: 1523
  VP8* aa65-223 short P[6]-Variant SP(CD5) w/o glyco CDS opt

SEQ ID NO: 3384 - RNA, 552 nt, Artificial Sequence; identical to SEQ ID NO: 1527
  VP8* aa65-223 short P[6]-Variant SP(HLA-A2) w/o glyco CDS opt

SEQ ID NO: 3385 - RNA, 603 nt, Artificial Sequence; identical to SEQ ID NO: 1531
  VP8* aa65-223 short P[6]-Variant SP(TPA)+P2+Linker w/o glyco CDS opt

SEQ ID NO: 3386 - RNA, 594 nt, Artificial Sequence; identical to SEQ ID NO: 1535
  VP8* aa65-223 short P[6]-Variant SP(HSA)+P2+Linker w/o glyco CDS opt

SEQ ID NO: 3387 - RNA, 594 nt, Artificial Sequence; identical to SEQ ID NO: 1539
  VP8* aa65-223 short P[6]-Variant SP(IgE)+P2+Linker w/o glyco CDS opt

SEQ ID NO: 3388 - RNA, 612 nt, Artificial Sequence; identical to SEQ ID NO: 1543
  VP8* aa65-223 short P[6]-Variant SP(CD5)+P2+Linker w/o glyco CDS opt

SEQ ID NO: 3389 - RNA, 612 nt, Artificial Sequence; identical to SEQ ID NO: 1547
  VP8* aa65-223 short P[6]-Variant SP(HLA-A2)+P2+Linker w/o glyco CDS opt

SEQ ID NO: 3390 - RNA, 483 nt, Artificial Sequence; identical to SEQ ID NO: 1503
  VP8* aa64-223 short P[6]-Variant w/o glyco CDS opt

SEQ ID NO: 3391 - RNA, 546 nt, Artificial Sequence; identical to SEQ ID NO: 1577
  VP8* aa64-223 short P[6]-Variant P2+Linker w/o glyco CDS opt

SEQ ID NO: 3392 - RNA, 546 nt, Artificial Sequence; identical to SEQ ID NO: 1579
  VP8* aa64-223 short P[6]-Variant SP(TPA) w/o glyco CDS opt

SEQ ID NO: 3393 - RNA, 537 nt, Artificial Sequence; identical to SEQ ID NO: 1581
  VP8* aa64-223 short P[6]-Variant SP(HSA) w/o glyco CDS opt

SEQ ID NO: 3394 - RNA, 537 nt, Artificial Sequence; identical to SEQ ID NO: 1583
  VP8* aa64-223 short P[6]-Variant SP(IgE) w/o glyco CDS opt

SEQ ID NO: 3395 - RNA, 555 nt, Artificial Sequence; identical to SEQ ID NO: 1585
  VP8* aa64-223 short P[6]-Variant SP(CD5) w/o glyco CDS opt

SEQ ID NO: 3396 - RNA, 555 nt, Artificial Sequence; identical to SEQ ID NO: 1587
  VP8* aa64-223 short P[6]-Variant SP(HLA-A2) w/o glyco CDS opt

SEQ ID NO: 3397 - RNA, 606 nt, Artificial Sequence; identical to SEQ ID NO: 1589
  VP8* aa64-223 short P[6]-Variant SP(TPA)+P2+Linker w/o glyco CDS opt

SEQ ID NO: 3398 - RNA, 597 nt, Artificial Sequence; identical to SEQ ID NO: 1591
  VP8* aa64-223 short P[6]-Variant SP(HSA)+P2+Linker w/o glyco CDS opt

SEQ ID NO: 3399 - RNA, 597 nt, Artificial Sequence; identical to SEQ ID NO: 1593
  VP8* aa64-223 short P[6]-Variant SP(IgE)+P2+Linker w/o glyco CDS opt

SEQ ID NO: 3400 - RNA, 615 nt, Artificial Sequence; identical to SEQ ID NO: 1595
  VP8* aa64-223 short P[6]-Variant SP(CD5)+P2+Linker w/o glyco CDS opt

SEQ ID NO: 3401 - RNA, 615 nt, Artificial Sequence; identical to SEQ ID NO: 1597
  VP8* aa64-223 short P[6]-Variant SP(HLA-A2)+P2+Linker w/o glyco CDS opt

SEQ ID NO: 3402 - RNA, 940 nt, Artificial Sequence
  VP8* aa2-240 long P[6]-Variant w/o glyco mRNA opt Design1
gggagaaagcuuaccauggccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3403 - RNA, 1000 nt, Artificial Sequence
  VP8* aa2-240 long P[6]-Variant P2+Linker w/o glyco mRNA opt Design1
gggagaaagcuuaccaugcaguacaucaaggccaacagcaaguucaucggcaucaccgagcugggcagcggguccggcgccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3404 - RNA, 1000 nt, Artificial Sequence
  VP8* aa2-240 long P[6]-Variant SP(TPA) w/o glyco mRNA opt Design1
gggagaaagcuuaccauggacgccaugaagcgcggccugugcugcgugcuccugcugugcggggccgucuucgugagcgccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3405 - RNA, 991 nt, Artificial Sequence
  VP8* aa2-240 long P[6]-Variant SP(HSA) w/o glyco mRNA opt Design1
gggagaaagcuuaccaugaagugggugaccuucaucagccugcucuuccuguucuccagcgccuacuccgccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3406 - RNA, 991 nt, Artificial Sequence
  VP8* aa2-240 long P[6]-Variant SP(IgE) w/o glyco mRNA opt Design1
gggagaaagcuuaccauggacuggaccuggauccuguuccucguggccgccgcgacccgcguccacagcgccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3407 - RNA, 1009 nt, Artificial Sequence
  VP8* aa2-240 long P[6]-Variant SP(CD5) w/o glyco mRNA opt Design1
gggagaaagcuuaccaugcccaugggcagccugcagccgcucgccacccuguaccugcucgggaugcugguggccuccugccugggcgccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3408 - RNA, 1009 nt, Artificial Sequence
  VP8* aa2-240 long P[6]-Variant SP(HLA-A2) w/o glyco mRNA opt Design1
gggagaaagcuuaccauggccgugauggccccgcggacccugguccuccugcugagcggcgcgcucgcccugacccagacgugggccgccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3409 - RNA, 1060 nt, Artificial Sequence
  VP8* aa2-240 long P[6]-Variant SP(TPA)+P2+Linker w/o glyco mRNA opt Design1
gggagaaagcuuaccauggacgccaugaagcgcggccugugcugcgugcuccugcugugcggggccgucuucgugagccaguacaucaaggccaacagcaaguucaucggcaucaccgagcugggcagcggguccggcgccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3410 - RNA, 1051 nt, Artificial Sequence
  VP8* aa2-240 long P[6]-Variant SP(HSA)+P2+Linker w/o glyco mRNA opt Design1
gggagaaagcuuaccaugaagugggugaccuucaucagccugcucuuccuguucuccagcgccuacucccaguacaucaaggccaacagcaaguucaucggcaucaccgagcugggcagcggguccggcgccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3411 - RNA, 1051 nt, Artificial Sequence
  VP8* aa2-240 long P[6]-Variant SP(IgE)+P2+Linker w/o glyco mRNA opt Design1
gggagaaagcuuaccauggacuggaccuggauccuguuccucguggccgccgcgacccgcguccacagccaguacaucaaggccaacagcaaguucaucggcaucaccgagcugggcagcggguccggcgccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3412 - RNA, 1069 nt, Artificial Sequence
  VP8* aa2-240 long P[6]-Variant SP(CD5)+P2+Linker w/o glyco mRNA opt Design1
gggagaaagcuuaccaugcccaugggcagccugcagccgcucgccacccuguaccugcucgggaugcugguggccuccugccugggccaguacaucaaggccaacagcaaguucaucggcaucaccgagcugggcagcggguccggcgccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3413 - RNA, 1069 nt, Artificial Sequence
  VP8* aa2-240 long P[6]-Variant SP(HLA-A2)+P2+Linker w/o glyco mRNA opt Design1
gggagaaagcuuaccauggccgugauggccccgcggacccugguccuccugcugagcggcgcgcucgcccugacccagacgugggcccaguacaucaaggccaacagcaaguucaucggcaucaccgagcugggcagcggguccggcgccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3414 - RNA, 910 nt, Artificial Sequence; identical to SEQ ID NO: 1771
  VP8* aa2-230 P[6]-Variant w/o glyco mRNA opt Design1

SEQ ID NO: 3415 - RNA, 970 nt, Artificial Sequence; identical to SEQ ID NO: 1775
  VP8* aa2-230 P[6]-Variant P2+Linker w/o glyco mRNA opt Design1

SEQ ID NO: 3416 - RNA, 970 nt, Artificial Sequence; identical to SEQ ID NO: 1779
  VP8* aa2-230 P[6]-Variant SP(TPA) w/o glyco mRNA opt Design1

SEQ ID NO: 3417 - RNA, 961 nt, Artificial Sequence; identical to SEQ ID NO: 1783
  VP8* aa2-230 P[6]-Variant SP(HSA) w/o glyco mRNA opt Design1

SEQ ID NO: 3418 - RNA, 961 nt, Artificial Sequence; identical to SEQ ID NO: 1787
  VP8* aa2-230 P[6]-Variant SP(IgE) w/o glyco mRNA opt Design1

SEQ ID NO: 3419 - RNA, 979 nt, Artificial Sequence; identical to SEQ ID NO: 1791
  VP8* aa2-230 P[6]-Variant SP(CD5) w/o glyco mRNA opt Design1

SEQ ID NO: 3420 - RNA, 979 nt, Artificial Sequence; identical to SEQ ID NO: 1795
  VP8* aa2-230 P[6]-Variant SP(HLA-A2) w/o glyco mRNA opt Design1

SEQ ID NO: 3421 - RNA, 1030 nt, Artificial Sequence; identical to SEQ ID NO: 1799
  VP8* aa2-230 P[6]-Variant SP(TPA)+P2+Linker w/o glyco mRNA opt Design1

SEQ ID NO: 3422 - RNA, 1021 nt, Artificial Sequence; identical to SEQ ID NO: 1803
  VP8* aa2-230 P[6]-Variant SP(HSA)+P2+Linker w/o glyco mRNA opt Design1

SEQ ID NO: 3423 - RNA, 1021 nt, Artificial Sequence; identical to SEQ ID NO: 1807
  VP8* aa2-230 P[6]-Variant SP(IgE)+P2+Linker w/o glyco mRNA opt Design1

SEQ ID NO: 3424 - RNA, 1039 nt, Artificial Sequence; identical to SEQ ID NO: 1811
  VP8* aa2-230 P[6]-Variant SP(CD5)+P2+Linker w/o glyco mRNA opt Design1

SEQ ID NO: 3425 - RNA, 1039 nt, Artificial Sequence; identical to SEQ ID NO: 1815
  VP8* aa2-230 P[6]-Variant SP(HLA-A2)+P2+Linker w/o glyco mRNA opt Design1

SEQ ID NO: 3426 - RNA, 862 nt, Artificial Sequence; identical to SEQ ID NO: 1867
  VP8* aa11-223 P[6]-Variant w/o glyco mRNA opt Design1

SEQ ID NO: 3427 - RNA, 922 nt, Artificial Sequence; identical to SEQ ID NO: 1871
  VP8* aa11-223 P[6]-Variant P2+Linker w/o glyco mRNA opt Design1

SEQ ID NO: 3428 - RNA, 922 nt, Artificial Sequence; identical to SEQ ID NO: 1875
  VP8* aa11-223 P[6]-Variant SP(TPA) w/o glyco mRNA opt Design1

SEQ ID NO: 3429 - RNA, 913 nt, Artificial Sequence; identical to SEQ ID NO: 1879
  VP8* aa11-223 P[6]-Variant SP(HSA) w/o glyco mRNA opt Design1

SEQ ID NO: 3430 - RNA, 913 nt, Artificial Sequence; identical to SEQ ID NO: 1883
  VP8* aa11-223 P[6]-Variant SP(IgE) w/o glyco mRNA opt Design1

SEQ ID NO: 3431 - RNA, 931 nt, Artificial Sequence; identical to SEQ ID NO: 1887
  VP8* aa11-223 P[6]-Variant SP(CD5) w/o glyco mRNA opt Design1

SEQ ID NO: 3432 - RNA, 931 nt, Artificial Sequence; identical to SEQ ID NO: 1891
  VP8* aa11-223 P[6]-Variant SP(HLA-A2) w/o glyco mRNA opt Design1

SEQ ID NO: 3433 - RNA, 982 nt, Artificial Sequence; identical to SEQ ID NO: 1895
  VP8* aa11-223 P[6]-Variant SP(TPA)+P2+Linker w/o glyco mRNA opt Design1

SEQ ID NO: 3434 - RNA, 973 nt, Artificial Sequence; identical to SEQ ID NO: 1899
  VP8* aa11-223 P[6]-Variant SP(HSA)+P2+Linker w/o glyco mRNA opt Design1

SEQ ID NO: 3435 - RNA, 973 nt, Artificial Sequence; identical to SEQ ID NO: 1903
  VP8* aa11-223 P[6]-Variant SP(IgE)+P2+Linker w/o glyco mRNA opt Design1

SEQ ID NO: 3436 - RNA, 991 nt, Artificial Sequence; identical to SEQ ID NO: 1907
  VP8* aa11-223 P[6]-Variant SP(CD5)+P2+Linker w/o glyco mRNA opt Design1

SEQ ID NO: 3437 - RNA, 991 nt, Artificial Sequence; identical to SEQ ID NO: 1911
  VP8* aa11-223 P[6]-Variant SP(HLA-A2)+P2+Linker w/o glyco mRNA opt Design1

SEQ ID NO: 3438 - RNA, 913 nt, Artificial Sequence
  VP8* aa11-240 P[6]-Variant w/o glyco mRNA opt Design1
gggagaaagcuuaccaugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3439 - RNA, 973 nt, Artificial Sequence
  VP8* aa11-240 P[6]-Variant P2+Linker w/o glyco mRNA opt Design1
gggagaaagcuuaccaugcaguacaucaaggccaacagcaaguucaucggcaucaccgagcugggcagcggguccggcaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3440 - RNA, 973 nt, Artificial Sequence
  VP8* aa11-240 P[6]-Variant SP(TPA) w/o glyco mRNA opt Design1
gggagaaagcuuaccauggacgccaugaagcgcggccugugcugcgugcuccugcugugcggggccgucuucgugagcaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3441 - RNA, 964 nt, Artificial Sequence
  VP8* aa11-240 P[6]-Variant SP(HSA) w/o glyco mRNA opt Design1
gggagaaagcuuaccaugaagugggugaccuucaucagccugcucuuccuguucuccagcgccuacuccaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3442 - RNA, 964 nt, Artificial Sequence
  VP8* aa11-240 P[6]-Variant SP(IgE) w/o glyco mRNA opt Design1
gggagaaagcuuaccauggacuggaccuggauccuguuccucguggccgccgcgacccgcguccacagcaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3443 - RNA, 982 nt, Artificial Sequence
  VP8* aa11-240 P[6]-Variant SP(CD5) w/o glyco mRNA opt Design1
gggagaaagcuuaccaugcccaugggcagccugcagccgcucgccacccuguaccugcucgggaugcugguggccuccugccugggcaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3444 - RNA, 982 nt, Artificial Sequence
  VP8* aa11-240 P[6]-Variant SP(HLA-A2) w/o glyco mRNA opt Design1
gggagaaagcuuaccauggccgugauggccccgcggacccugguccuccugcugagcggcgcgcucgcccugacccagacgugggccaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3445 - RNA, 1033 nt, Artificial Sequence
  VP8* aa11-240 P[6]-Variant SP(TPA)+P2+Linker w/o glyco mRNA opt Design1
gggagaaagcuuaccauggacgccaugaagcgcggccugugcugcgugcuccugcugugcggggccgucuucgugagccaguacaucaaggccaacagcaaguucaucggcaucaccgagcugggcagcggguccggcaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3446 - RNA, 1024 nt, Artificial Sequence
  VP8* aa11-240 P[6]-Variant SP(HSA)+P2+Linker w/o glyco mRNA opt Design1
gggagaaagcuuaccaugaagugggugaccuucaucagccugcucuuccuguucuccagcgccuacucccaguacaucaaggccaacagcaaguucaucggcaucaccgagcugggcagcggguccggcaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3447 - RNA, 1024 nt, Artificial Sequence
  VP8* aa11-240 P[6]-Variant SP(IgE)+P2+Linker w/o glyco mRNA opt Design1
gggagaaagcuuaccauggacuggaccuggauccuguuccucguggccgccgcgacccgcguccacagccaguacaucaaggccaacagcaaguucaucggcaucaccgagcugggcagcggguccggcaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3448 - RNA, 1042 nt, Artificial Sequence
  VP8* aa11-240 P[6]-Variant SP(CD5)+P2+Linker w/o glyco mRNA opt Design1
gggagaaagcuuaccaugcccaugggcagccugcagccgcucgccacccuguaccugcucgggaugcugguggccuccugccugggccaguacaucaaggccaacagcaaguucaucggcaucaccgagcugggcagcggguccggcaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3449 - RNA, 1042 nt, Artificial Sequence
  VP8* aa11-240 P[6]-Variant SP(HLA-A2)+P2+Linker w/o glyco mRNA opt Design1
gggagaaagcuuaccauggccgugauggccccgcggacccugguccuccugcugagcggcgcgcucgcccugacccagacgugggcccaguacaucaaggccaacagcaaguucaucggcaucaccgagcugggcagcggguccggcaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3450 - RNA, 883 nt, Artificial Sequence
  VP8* aa21-240 P[6]-Variant w/o glyco mRNA opt Design1
gggagaaagcuuaccauggagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3451 - RNA, 943 nt, Artificial Sequence
  VP8* aa21-240 P[6]-Variant P2+Linker w/o glyco mRNA opt Design1
gggagaaagcuuaccaugcaguacaucaaggccaacagcaaguucaucggcaucaccgagcugggcagcggguccggcgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3452 - RNA, 943 nt, Artificial Sequence
  VP8* aa21-240 P[6]-Variant SP(TPA) w/o glyco mRNA opt Design1
gggagaaagcuuaccauggacgccaugaagcgcggccugugcugcgugcuccugcugugcggggccgucuucgugagcgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3453 - RNA, 934 nt, Artificial Sequence
  VP8* aa21-240 P[6]-Variant SP(HSA) w/o glyco mRNA opt Design1
gggagaaagcuuaccaugaagugggugaccuucaucagccugcucuuccuguucuccagcgccuacuccgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3454 - RNA, 934 nt, Artificial Sequence
  VP8* aa21-240 P[6]-Variant SP(IgE) w/o glyco mRNA opt Design1
gggagaaagcuuaccauggacuggaccuggauccuguuccucguggccgccgcgacccgcguccacagcgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3455 - RNA, 952 nt, Artificial Sequence
  VP8* aa21-240 P[6]-Variant SP(CD5) w/o glyco mRNA opt Design1
gggagaaagcuuaccaugcccaugggcagccugcagccgcucgccacccuguaccugcucgggaugcugguggccuccugccugggcgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3456 - RNA, 952 nt, Artificial Sequence
  VP8* aa21-240 P[6]-Variant SP(HLA-A2) w/o glyco mRNA opt Design1
gggagaaagcuuaccauggccgugauggccccgcggacccugguccuccugcugagcggcgcgcucgcccugacccagacgugggccgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3457 - RNA, 1003 nt, Artificial Sequence
  VP8* aa21-240 P[6]-Variant SP(TPA)+P2+Linker w/o glyco mRNA opt Design1
gggagaaagcuuaccauggacgccaugaagcgcggccugugcugcgugcuccugcugugcggggccgucuucgugagccaguacaucaaggccaacagcaaguucaucggcaucaccgagcugggcagcggguccggcgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3458 - RNA, 994 nt, Artificial Sequence
  VP8* aa21-240 P[6]-Variant SP(HSA)+P2+Linker w/o glyco mRNA opt Design1
gggagaaagcuuaccaugaagugggugaccuucaucagccugcucuuccuguucuccagcgccuacucccaguacaucaaggccaacagcaaguucaucggcaucaccgagcugggcagcggguccggcgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3459 - RNA, 994 nt, Artificial Sequence
  VP8* aa21-240 P[6]-Variant SP(IgE)+P2+Linker w/o glyco mRNA opt Design1
gggagaaagcuuaccauggacuggaccuggauccuguuccucguggccgccgcgacccgcguccacagccaguacaucaaggccaacagcaaguucaucggcaucaccgagcugggcagcggguccggcgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3460 - RNA, 1012 nt, Artificial Sequence
  VP8* aa21-240 P[6]-Variant SP(CD5)+P2+Linker w/o glyco mRNA opt Design1
gggagaaagcuuaccaugcccaugggcagccugcagccgcucgccacccuguaccugcucgggaugcugguggccuccugccugggccaguacaucaaggccaacagcaaguucaucggcaucaccgagcugggcagcggguccggcgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3461 - RNA, 1012 nt, Artificial Sequence
  VP8* aa21-240 P[6]-Variant SP(HLA-A2)+P2+Linker w/o glyco mRNA opt Design1
gggagaaagcuuaccauggccgugauggccccgcggacccugguccuccugcugagcggcgcgcucgcccugacccagacgugggcccaguacaucaaggccaacagcaaguucaucggcaucaccgagcugggcagcggguccggcgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3462 - RNA, 772 nt, Artificial Sequence; identical to SEQ ID NO: 2155
  VP8* aa41-223P[6]-Variant w/o glyco mRNA opt Design1

SEQ ID NO: 3463 - RNA, 832 nt, Artificial Sequence; identical to SEQ ID NO: 2159
  VP8* aa41-223P[6]-Variant P2+Linker w/o glyco mRNA opt Design1

SEQ ID NO: 3464 - RNA, 832 nt, Artificial Sequence; identical to SEQ ID NO: 2163
  VP8* aa41-223P[6]-Variant SP(TPA) w/o glyco mRNA opt Design1

SEQ ID NO: 3465 - RNA, 823 nt, Artificial Sequence; identical to SEQ ID NO: 2167
  VP8* aa41-223P[6]-Variant SP(HSA) w/o glyco mRNA opt Design1

SEQ ID NO: 3466 - RNA, 823 nt, Artificial Sequence; identical to SEQ ID NO: 2171
  VP8* aa41-223P[6]-Variant SP(IgE) w/o glyco mRNA opt Design1

SEQ ID NO: 3467 - RNA, 841 nt, Artificial Sequence; identical to SEQ ID NO: 2175
  VP8* aa41-223P[6]-Variant SP(CD5) w/o glyco mRNA opt Design1

SEQ ID NO: 3468 - RNA, 841 nt, Artificial Sequence; identical to SEQ ID NO: 2179
  VP8* aa41-223P[6]-Variant SP(HLA-A2) w/o glyco mRNA opt Design1

SEQ ID NO: 3469 - RNA, 892 nt, Artificial Sequence; identical to SEQ ID NO: 2183
  VP8* aa41-223P[6]-Variant SP(TPA)+P2+Linker w/o glyco mRNA opt Design1

SEQ ID NO: 3470 - RNA, 883 nt, Artificial Sequence; identical to SEQ ID NO: 2187
  VP8* aa41-223P[6]-Variant SP(HSA)+P2+Linker w/o glyco mRNA opt Design1

SEQ ID NO: 3471 - RNA, 883 nt, Artificial Sequence; identical to SEQ ID NO: 2191
  VP8* aa41-223P[6]-Variant SP(IgE)+P2+Linker w/o glyco mRNA opt Design1

SEQ ID NO: 3472 - RNA, 901 nt, Artificial Sequence; identical to SEQ ID NO: 2195
  VP8* aa41-223P[6]-Variant SP(CD5)+P2+Linker w/o glyco mRNA opt Design1

SEQ ID NO: 3473 - RNA, 901 nt, Artificial Sequence; identical to SEQ ID NO: 2199
  VP8* aa41-223 P[6]-Variant SP(HLA-A2)+P2+Linker w/o glyco mRNA opt Design1

SEQ ID NO: 3474 - RNA, 700 nt, Artificial Sequence; identical to SEQ ID NO: 2251
  VP8* aa65-223 short P[6]-Variant w/o glyco mRNA opt Design1

SEQ ID NO: 3475 - RNA, 760 nt, Artificial Sequence; identical to SEQ ID NO: 2255
  VP8* aa65-223 short P[6]-Variant P2+Linker w/o glyco mRNA opt Design1

SEQ ID NO: 3476 - RNA, 760 nt, Artificial Sequence; identical to SEQ ID NO: 2259
  VP8* aa65-223 short P[6]-Variant SP(TPA) w/o glyco mRNA opt Design1

SEQ ID NO: 3477 - RNA, 751 nt, Artificial Sequence; identical to SEQ ID NO: 2263
  VP8* aa65-223 short P[6]-Variant SP(HSA) w/o glyco mRNA opt Design1

SEQ ID NO: 3478 - RNA, 751 nt, Artificial Sequence; identical to SEQ ID NO: 2267
  VP8* aa65-223 short P[6]-Variant SP(IgE) w/o glyco mRNA opt Design1

SEQ ID NO: 3479 - RNA, 769 nt, Artificial Sequence; identical to SEQ ID NO: 2271
  VP8* aa65-223 short P[6]-Variant SP(CD5) w/o glyco mRNA opt Design1

SEQ ID NO: 3480 - RNA, 769 nt, Artificial Sequence; identical to SEQ ID NO: 2275
  VP8* aa65-223 short P[6]-Variant SP(HLA-A2) w/o glyco mRNA opt Design1

SEQ ID NO: 3481 - RNA, 820 nt, Artificial Sequence; identical to SEQ ID NO: 2279
  VP8* aa65-223 short P[6]-Variant SP(TPA)+P2+Linker w/o glyco mRNA opt Design1

SEQ ID NO: 3482 - RNA, 811 nt, Artificial Sequence; identical to SEQ ID NO: 2283
  VP8* aa65-223 short P[6]-Variant SP(HSA)+P2+Linker w/o glyco mRNA opt Design1

SEQ ID NO: 3483 - RNA, 811 nt, Artificial Sequence; identical to SEQ ID NO: 2287
  VP8* aa65-223 short P[6]-Variant SP(IgE)+P2+Linker w/o glyco mRNA opt Design1

SEQ ID NO: 3484 - RNA, 829 nt, Artificial Sequence; identical to SEQ ID NO: 2291
  VP8* aa65-223 short P[6]-Variant SP(CD5)+P2+Linker w/o glyco mRNA opt Design1

SEQ ID NO: 3485 - RNA, 829 nt, Artificial Sequence; identical to SEQ ID NO: 2295
  VP8* aa65-223 short P[6]-Variant SP(HLA-A2)+P2+Linker w/o glyco mRNA opt Design1

SEQ ID NO: 3486 - RNA, 700 nt, Artificial Sequence; identical to SEQ ID NO: 2251
  VP8* aa64-223 short P[6]-Variant w/o glyco mRNA opt Design1

SEQ ID NO: 3487 - RNA, 763 nt, Artificial Sequence; identical to SEQ ID NO: 2325
  VP8* aa64-223 short P[6]-Variant P2+Linker w/o glyco mRNA opt Design1

SEQ ID NO: 3488 - RNA, 763 nt, Artificial Sequence; identical to SEQ ID NO: 2327
  VP8* aa64-223 short P[6]-Variant SP(TPA) w/o glyco mRNA opt Design1

SEQ ID NO: 3489 - RNA, 754 nt, Artificial Sequence; identical to SEQ ID NO: 2329
  VP8* aa64-223 short P[6]-Variant SP(HSA) w/o glyco mRNA opt Design1

SEQ ID NO: 3490 - RNA, 754 nt, Artificial Sequence; identical to SEQ ID NO: 2331
  VP8* aa64-223 short P[6]-Variant SP(IgE) w/o glyco mRNA opt Design1

SEQ ID NO: 3491 - RNA, 772 nt, Artificial Sequence; identical to SEQ ID NO: 2333
  VP8* aa64-223 short P[6]-Variant SP(CD5) w/o glyco mRNA opt Design1

SEQ ID NO: 3492 - RNA, 772 nt, Artificial Sequence; identical to SEQ ID NO: 2335
  VP8* aa64-223 short P[6]-Variant SP(HLA-A2) w/o glyco mRNA opt Design1

SEQ ID NO: 3493 - RNA, 823 nt, Artificial Sequence; identical to SEQ ID NO: 2337
  VP8* aa64-223 short P[6]-Variant SP(TPA)+P2+Linker w/o glyco mRNA opt Design1

SEQ ID NO: 3494 - RNA, 814 nt, Artificial Sequence; identical to SEQ ID NO: 2339
  VP8* aa64-223 short P[6]-Variant SP(HSA)+P2+Linker w/o glyco mRNA opt Design1

SEQ ID NO: 3495 - RNA, 814 nt, Artificial Sequence; identical to SEQ ID NO: 2341
  VP8* aa64-223 short P[6]-Variant SP(IgE)+P2+Linker w/o glyco mRNA opt Design1

SEQ ID NO: 3496 - RNA, 832 nt, Artificial Sequence; identical to SEQ ID NO: 2343
  VP8* aa64-223 short P[6]-Variant SP(CD5)+P2+Linker w/o glyco mRNA opt Design1

SEQ ID NO: 3497 - RNA, 832 nt, Artificial Sequence; identical to SEQ ID NO: 2345
  VP8* aa64-223 short P[6]-Variant SP(HLA-A2)+P2+Linker w/o glyco mRNA opt Design1

SEQ ID NO: 3498 - RNA, 1105 nt, Artificial Sequence
  VP8* aa2-240 long P[6]-Variant w/o glyco mRNA opt Design2
ggggcgcugccuacggagguggcagccaucuccuucucggcaucaagcuuaccauggccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3499 - RNA, 1165 nt, Artificial Sequence
  VP8* aa2-240 long P[6]-Variant P2+Linker w/o glyco mRNA opt Design2
ggggcgcugccuacggagguggcagccaucuccuucucggcaucaagcuuaccaugcaguacaucaaggccaacagcaaguucaucggcaucaccgagcugggcagcggguccggcgccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3500 - RNA, 1165 nt, Artificial Sequence
  VP8* aa2-240 long P[6]-Variant SP(TPA) w/o glyco mRNA opt Design2
ggggcgcugccuacggagguggcagccaucuccuucucggcaucaagcuuaccauggacgccaugaagcgcggccugugcugcgugcuccugcugugcggggccgucuucgugagcgccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3501 - RNA, 1156 nt, Artificial Sequence
  VP8* aa2-240 long P[6]-Variant SP(HSA) w/o glyco mRNA opt Design2
ggggcgcugccuacggagguggcagccaucuccuucucggcaucaagcuuaccaugaagugggugaccuucaucagccugcucuuccuguucuccagcgccuacuccgccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3502 - RNA, 1156 nt, Artificial Sequence
  VP8* aa2-240 long P[6]-Variant SP(IgE) w/o glyco mRNA opt Design2
ggggcgcugccuacggagguggcagccaucuccuucucggcaucaagcuuaccauggacuggaccuggauccuguuccucguggccgccgcgacccgcguccacagcgccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3503 - RNA, 1174 nt, Artificial Sequence
  VP8* aa2-240 long P[6]-Variant SP(CD5) w/o glyco mRNA opt Design2
ggggcgcugccuacggagguggcagccaucuccuucucggcaucaagcuuaccaugcccaugggcagccugcagccgcucgccacccuguaccugcucgggaugcugguggccuccugccugggcgccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3504 - RNA, 1174 nt, Artificial Sequence
  VP8* aa2-240 long P[6]-Variant SP(HLA-A2) w/o glyco mRNA opt Design2
ggggcgcugccuacggagguggcagccaucuccuucucggcaucaagcuuaccauggccgugauggccccgcggacccugguccuccugcugagcggcgcgcucgcccugacccagacgugggccgccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3505 - RNA, 1225 nt, Artificial Sequence
  VP8* aa2-240 long P[6]-Variant SP(TPA)+P2+Linker w/o glyco mRNA opt Design2
ggggcgcugccuacggagguggcagccaucuccuucucggcaucaagcuuaccauggacgccaugaagcgcggccugugcugcgugcuccugcugugcggggccgucuucgugagccaguacaucaaggccaacagcaaguucaucggcaucaccgagcugggcagcggguccggcgccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3506 - RNA, 1216 nt, Artificial Sequence
  VP8* aa2-240 long P[6]-Variant SP(HSA)+P2+Linker w/o glyco mRNA opt Design2
ggggcgcugccuacggagguggcagccaucuccuucucggcaucaagcuuaccaugaagugggugaccuucaucagccugcucuuccuguucuccagcgccuacucccaguacaucaaggccaacagcaaguucaucggcaucaccgagcugggcagcggguccggcgccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3507 - RNA, 1216 nt, Artificial Sequence
  VP8* aa2-240 long P[6]-Variant SP(IgE)+P2+Linker w/o glyco mRNA opt Design2
ggggcgcugccuacggagguggcagccaucuccuucucggcaucaagcuuaccauggacuggaccuggauccuguuccucguggccgccgcgacccgcguccacagccaguacaucaaggccaacagcaaguucaucggcaucaccgagcugggcagcggguccggcgccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3508 - RNA, 1234 nt, Artificial Sequence
  VP8* aa2-240 long P[6]-Variant SP(CD5)+P2+Linker w/o glyco mRNA opt Design2
ggggcgcugccuacggagguggcagccaucuccuucucggcaucaagcuuaccaugcccaugggcagccugcagccgcucgccacccuguaccugcucgggaugcugguggccuccugccugggccaguacaucaaggccaacagcaaguucaucggcaucaccgagcugggcagcggguccggcgccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3509 - RNA, 1234 nt, Artificial Sequence
  VP8* aa2-240 long P[6]-Variant SP(HLA-A2)+P2+Linker w/o glyco mRNA opt Design2
ggggcgcugccuacggagguggcagccaucuccuucucggcaucaagcuuaccauggccgugauggccccgcggacccugguccuccugcugagcggcgcgcucgcccugacccagacgugggcccaguacaucaaggccaacagcaaguucaucggcaucaccgagcugggcagcggguccggcgccagccugaucuaccgccagcuccugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3510 - RNA, 1075 nt, Artificial Sequence; identical to SEQ ID NO: 2531
  VP8* aa2-230 P[6]-Variant w/o glyco mRNA opt Design2

SEQ ID NO: 3511 - RNA, 1135 nt, Artificial Sequence; identical to SEQ ID NO: 2535
  VP8* aa2-230 P[6]-Variant P2+Linker w/o glyco mRNA opt Design2

SEQ ID NO: 3512 - RNA, 1135 nt, Artificial Sequence; identical to SEQ ID NO: 2539
  VP8* aa2-230 P[6]-Variant SP(TPA) w/o glyco mRNA opt Design2

SEQ ID NO: 3513 - RNA, 1126 nt, Artificial Sequence; identical to SEQ ID NO: 2543
  VP8* aa2-230 P[6]-Variant SP(HSA) w/o glyco mRNA opt Design2

SEQ ID NO: 3514 - RNA, 1126 nt, Artificial Sequence; identical to SEQ ID NO: 2547
  VP8* aa2-230 P[6]-Variant SP(IgE) w/o glyco mRNA opt Design2

SEQ ID NO: 3515 - RNA, 1144 nt, Artificial Sequence; identical to SEQ ID NO: 2551
  VP8* aa2-230 P[6]-Variant SP(CD5) w/o glyco mRNA opt Design2

SEQ ID NO: 3516 - RNA, 1144 nt, Artificial Sequence; identical to SEQ ID NO: 2555
  VP8* aa2-230 P[6]-Variant SP(HLA-A2) w/o glyco mRNA opt Design2

SEQ ID NO: 3517 - RNA, 1195 nt, Artificial Sequence; identical to SEQ ID NO: 2559
  VP8* aa2-230 P[6]-Variant SP(TPA)+P2+Linker w/o glyco mRNA opt Design2

SEQ ID NO: 3518 - RNA, 1186 nt, Artificial Sequence; identical to SEQ ID NO: 2563
  VP8* aa2-230 P[6]-Variant SP(HSA)+P2+Linker w/o glyco mRNA opt Design2

SEQ ID NO: 3519 - RNA, 1186 nt, Artificial Sequence; identical to SEQ ID NO: 2567
  VP8* aa2-230 P[6]-Variant SP(IgE)+P2+Linker w/o glyco mRNA opt Design2

SEQ ID NO: 3520 - RNA, 1204 nt, Artificial Sequence; identical to SEQ ID NO: 2571
  VP8* aa2-230 P[6]-Variant SP(CD5)+P2+Linker w/o glyco mRNA opt Design2

SEQ ID NO: 3521 - RNA, 1204 nt, Artificial Sequence; identical to SEQ ID NO: 2575
  VP8* aa2-230 P[6]-Variant SP(HLA-A2)+P2+Linker w/o glyco mRNA opt Design2

SEQ ID NO: 3522 - RNA, 1027 nt, Artificial Sequence; identical to SEQ ID NO: 2627
  VP8* aa11-223 P[6]-Variant w/o glyco mRNA opt Design2

SEQ ID NO: 3523 - RNA, 1087 nt, Artificial Sequence; identical to SEQ ID NO: 2631
  VP8* aa11-223 P[6]-Variant P2+Linker w/o glyco mRNA opt Design2

SEQ ID NO: 3524 - RNA, 1087 nt, Artificial Sequence; identical to SEQ ID NO: 2635
  VP8* aa11-223 P[6]-Variant SP(TPA) w/o glyco mRNA opt Design2

SEQ ID NO: 3525 - RNA, 1078 nt, Artificial Sequence; identical to SEQ ID NO: 2639
  VP8* aa11-223 P[6]-Variant SP(HSA) w/o glyco mRNA opt Design2

SEQ ID NO: 3526 - RNA, 1078 nt, Artificial Sequence; identical to SEQ ID NO: 2643
  VP8* aa11-223 P[6]-Variant SP(IgE) w/o glyco mRNA opt Design2

SEQ ID NO: 3527 - RNA, 1096 nt, Artificial Sequence; identical to SEQ ID NO: 2647
  VP8* aa11-223 P[6]-Variant SP(CD5) w/o glyco mRNA opt Design2

SEQ ID NO: 3528 - RNA, 1096 nt, Artificial Sequence; identical to SEQ ID NO: 2651
  VP8* aa11-223 P[6]-Variant SP(HLA-A2) w/o glyco mRNA opt Design2

SEQ ID NO: 3529 - RNA, 1147 nt, Artificial Sequence; identical to SEQ ID NO: 2655
  VP8* aa11-223 P[6]-Variant SP(TPA)+P2+Linker w/o glyco mRNA opt Design2

SEQ ID NO: 3530 - RNA, 1138 nt, Artificial Sequence; identical to SEQ ID NO: 2659
  VP8* aa11-223 P[6]-Variant SP(HSA)+P2+Linker w/o glyco mRNA opt Design2

SEQ ID NO: 3531 - RNA, 1138 nt, Artificial Sequence; identical to SEQ ID NO: 2663
  VP8* aa11-223 P[6]-Variant SP(IgE)+P2+Linker w/o glyco mRNA opt Design2

SEQ ID NO: 3532 - RNA, 1156 nt, Artificial Sequence; identical to SEQ ID NO: 2667
  VP8* aa11-223 P[6]-Variant SP(CD5)+P2+Linker w/o glyco mRNA opt Design2

SEQ ID NO: 3533 - RNA, 1156 nt, Artificial Sequence; identical to SEQ ID NO: 2671
  VP8* aa11-223 P[6]-Variant SP(HLA-A2)+P2+Linker w/o glyco mRNA opt Design2

SEQ ID NO: 3534 - RNA, 1078 nt, Artificial Sequence
  VP8* aa11-240 P[6]-Variant w/o glyco mRNA opt Design2
ggggcgcugccuacggagguggcagccaucuccuucucggcaucaagcuuaccaugaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3535 - RNA, 1138 nt, Artificial Sequence
  VP8* aa11-240 P[6]-Variant P2+Linker w/o glyco mRNA opt Design2
ggggcgcugccuacggagguggcagccaucuccuucucggcaucaagcuuaccaugcaguacaucaaggccaacagcaaguucaucggcaucaccgagcugggcagcggguccggcaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3536 - RNA, 1138 nt, Artificial Sequence
  VP8* aa11-240 P[6]-Variant SP(TPA) w/o glyco mRNA opt Design2
ggggcgcugccuacggagguggcagccaucuccuucucggcaucaagcuuaccauggacgccaugaagcgcggccugugcugcgugcuccugcugugcggggccgucuucgugagcaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3537 - RNA, 1129 nt, Artificial Sequence
  VP8* aa11-240 P[6]-Variant SP(HSA) w/o glyco mRNA opt Design2
ggggcgcugccuacggagguggcagccaucuccuucucggcaucaagcuuaccaugaagugggugaccuucaucagccugcucuuccuguucuccagcgccuacuccaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3538 - RNA, 1129 nt, Artificial Sequence
  VP8* aa11-240 P[6]-Variant SP(IgE) w/o glyco mRNA opt Design2
ggggcgcugccuacggagguggcagccaucuccuucucggcaucaagcuuaccauggacuggaccuggauccuguuccucguggccgccgcgacccgcguccacagcaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3539 - RNA, 1147 nt, Artificial Sequence
  VP8* aa11-240 P[6]-Variant SP(CD5) w/o glyco mRNA opt Design2
ggggcgcugccuacggagguggcagccaucuccuucucggcaucaagcuuaccaugcccaugggcagccugcagccgcucgccacccuguaccugcucgggaugcugguggccuccugccugggcaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3540 - RNA, 1147 nt, Artificial Sequence
  VP8* aa11-240 P[6]-Variant SP(HLA-A2) w/o glyco mRNA opt Design2
ggggcgcugccuacggagguggcagccaucuccuucucggcaucaagcuuaccauggccgugauggccccgcggacccugguccuccugcugagcggcgcgcucgcccugacccagacgugggccaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3541 - RNA, 1198 nt, Artificial Sequence
  VP8* aa11-240 P[6]-Variant SP(TPA)+P2+Linker w/o glyco mRNA opt Design2
ggggcgcugccuacggagguggcagccaucuccuucucggcaucaagcuuaccauggacgccaugaagcgcggccugugcugcgugcuccugcugugcggggccgucuucgugagccaguacaucaaggccaacagcaaguucaucggcaucaccgagcugggcagcggguccggcaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3542 - RNA, 1189 nt, Artificial Sequence
  VP8* aa11-240 P[6]-Variant SP(HSA)+P2+Linker w/o glyco mRNA opt Design2
ggggcgcugccuacggagguggcagccaucuccuucucggcaucaagcuuaccaugaagugggugaccuucaucagccugcucuuccuguucuccagcgccuacucccaguacaucaaggccaacagcaaguucaucggcaucaccgagcugggcagcggguccggcaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3543 - RNA, 1189 nt, Artificial Sequence
  VP8* aa11-240 P[6]-Variant SP(IgE)+P2+Linker w/o glyco mRNA opt Design2
ggggcgcugccuacggagguggcagccaucuccuucucggcaucaagcuuaccauggacuggaccuggauccuguuccucguggccgccgcgacccgcguccacagccaguacaucaaggccaacagcaaguucaucggcaucaccgagcugggcagcggguccggcaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3544 - RNA, 1207 nt, Artificial Sequence
  VP8* aa11-240 P[6]-Variant SP(CD5)+P2+Linker w/o glyco mRNA opt Design2
ggggcgcugccuacggagguggcagccaucuccuucucggcaucaagcuuaccaugcccaugggcagccugcagccgcucgccacccuguaccugcucgggaugcugguggccuccugccugggccaguacaucaaggccaacagcaaguucaucggcaucaccgagcugggcagcggguccggcaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3545 - RNA, 1207 nt, Artificial Sequence
  VP8* aa11-240 P[6]-Variant SP(HLA-A2)+P2+Linker w/o glyco mRNA opt Design2
ggggcgcugccuacggagguggcagccaucuccuucucggcaucaagcuuaccauggccgugauggccccgcggacccugguccuccugcugagcggcgcgcucgcccugacccagacgugggcccaguacaucaaggccaacagcaaguucaucggcaucaccgagcugggcagcggguccggcaccaacuccuacaccguggagcugagcgacgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3546 - RNA, 1048 nt, Artificial Sequence
  VP8* aa21-240 P[6]-Variant w/o glyco mRNA opt Design2
ggggcgcugccuacggagguggcagccaucuccuucucggcaucaagcuuaccauggagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3547 - RNA, 1108 nt, Artificial Sequence
  VP8* aa21-240 P[6]-Variant P2+Linker w/o glyco mRNA opt Design2
ggggcgcugccuacggagguggcagccaucuccuucucggcaucaagcuuaccaugcaguacaucaaggccaacagcaaguucaucggcaucaccgagcugggcagcggguccggcgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3548 - RNA, 1108 nt, Artificial Sequence
  VP8* aa21-240 P[6]-Variant SP(TPA) w/o glyco mRNA opt Design2
ggggcgcugccuacggagguggcagccaucuccuucucggcaucaagcuuaccauggacgccaugaagcgcggccugugcugcgugcuccugcugugcggggccgucuucgugagcgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3549 - RNA, 1099 nt, Artificial Sequence
  VP8* aa21-240 P[6]-Variant SP(HSA) w/o glyco mRNA opt Design2
ggggcgcugccuacggagguggcagccaucuccuucucggcaucaagcuuaccaugaagugggugaccuucaucagccugcucuuccuguucuccagcgccuacuccgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3550 - RNA, 1099 nt, Artificial Sequence
  VP8* aa21-240 P[6]-Variant SP(IgE) w/o glyco mRNA opt Design2
ggggcgcugccuacggagguggcagccaucuccuucucggcaucaagcuuaccauggacuggaccuggauccuguuccucguggccgccgcgacccgcguccacagcgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3551 - RNA, 1117 nt, Artificial Sequence
  VP8* aa21-240 P[6]-Variant SP(CD5) w/o glyco mRNA opt Design2
ggggcgcugccuacggagguggcagccaucuccuucucggcaucaagcuuaccaugcccaugggcagccugcagccgcucgccacccuguaccugcucgggaugcugguggccuccugccugggcgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3552 - RNA, 1117 nt, Artificial Sequence
  VP8* aa21-240 P[6]-Variant SP(HLA-A2) w/o glyco mRNA opt Design2
ggggcgcugccuacggagguggcagccaucuccuucucggcaucaagcuuaccauggccgugauggccccgcggacccugguccuccugcugagcggcgcgcucgcccugacccagacgugggccgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3553 - RNA, 1168 nt, Artificial Sequence
  VP8* aa21-240 P[6]-Variant SP(TPA)+P2+Linker w/o glyco mRNA opt Design2
ggggcgcugccuacggagguggcagccaucuccuucucggcaucaagcuuaccauggacgccaugaagcgcggccugugcugcgugcuccugcugugcggggccgucuucgugagccaguacaucaaggccaacagcaaguucaucggcaucaccgagcugggcagcggguccggcgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3554 - RNA, 1159 nt, Artificial Sequence
  VP8* aa21-240 P[6]-Variant SP(HSA)+P2+Linker w/o glyco mRNA opt Design2
ggggcgcugccuacggagguggcagccaucuccuucucggcaucaagcuuaccaugaagugggugaccuucaucagccugcucuuccuguucuccagcgccuacucccaguacaucaaggccaacagcaaguucaucggcaucaccgagcugggcagcggguccggcgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3555 - RNA, 1159 nt, Artificial Sequence
  VP8* aa21-240 P[6]-Variant SP(IgE)+P2+Linker w/o glyco mRNA opt Design2
ggggcgcugccuacggagguggcagccaucuccuucucggcaucaagcuuaccauggacuggaccuggauccuguuccucguggccgccgcgacccgcguccacagccaguacaucaaggccaacagcaaguucaucggcaucaccgagcugggcagcggguccggcgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3556 - RNA, 1177 nt, Artificial Sequence
  VP8* aa21-240 P[6]-Variant SP(CD5)+P2+Linker w/o glyco mRNA opt Design2
ggggcgcugccuacggagguggcagccaucuccuucucggcaucaagcuuaccaugcccaugggcagccugcagccgcucgccacccuguaccugcucgggaugcugguggccuccugccugggccaguacaucaaggccaacagcaaguucaucggcaucaccgagcugggcagcggguccggcgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3557 - RNA, 1177 nt, Artificial Sequence
  VP8* aa21-240 P[6]-Variant SP(HLA-A2)+P2+Linker w/o glyco mRNA opt Design2
ggggcgcugccuacggagguggcagccaucuccuucucggcaucaagcuuaccauggccgugauggccccgcggacccugguccuccugcugagcggcgcgcucgcccugacccagacgugggcccaguacaucaaggccaacagcaaguucaucggcaucaccgagcugggcagcggguccggcgagaucaacacgaucggcuccgagaagaaccagcaggucaccaucaaccccgggcccuucgcccagaccaacuacgcgcccgugaccuggagccacggcgaggugcaggacuccacgaccaucgagcccguccucgacgggcccuaccagccgaccaacuucaagccgcccaacgacuacuggauccugcugaaccccaccaaccagcagguggugcucgagggcacgcagaagaccgacaucugggucgcccugcugcucguggagccgcaggugacccagcagagccggcaguacacccuguucggggagacgaagcagaucaccgucgagcagaacaccaacaaguggaaguucuucgagauguuccgcuccagcguguccgccgaguuccagcacaagcggacccugacgagcgacaccaagcucgccggcuucaugaaguucuaccaguccguguggaccuuccacggcgagaccccccaggccacgaccgacuacagcuccaccagcaaccuguucgaggucgagaccgugauccacguggaguucuacaucaucccccgcucccaggagagcaagugcuccgaguacaucaacacggggcugcccccgaugcagaacacccggcagaucguccccguggcgcucagcucccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3558 - RNA, 937 nt, Artificial Sequence; identical to SEQ ID NO: 2915
  VP8* aa41-223P[6]-Variant w/o glyco mRNA opt Design2

SEQ ID NO: 3559 - RNA, 997 nt, Artificial Sequence; identical to SEQ ID NO: 2919
  VP8* aa41-223P[6]-Variant P2+Linker w/o glyco mRNA opt Design2

SEQ ID NO: 3560 - RNA, 997 nt, Artificial Sequence; identical to SEQ ID NO: 2923
  VP8* aa41-223P[6]-Variant SP(TPA) w/o glyco mRNA opt Design2

SEQ ID NO: 3561 - RNA, 988 nt, Artificial Sequence; identical to SEQ ID NO: 2927
  VP8* aa41-223P[6]-Variant SP(HSA) w/o glyco mRNA opt Design2

SEQ ID NO: 3562 - RNA, 988 nt, Artificial Sequence; identical to SEQ ID NO: 2931
  VP8* aa41-223P[6]-Variant SP(IgE) w/o glyco mRNA opt Design2

SEQ ID NO: 3563 - RNA, 1006 nt, Artificial Sequence; identical to SEQ ID NO: 2935
  VP8* aa41-223P[6]-Variant SP(CD5) w/o glyco mRNA opt Design2

SEQ ID NO: 3564 - RNA, 1006 nt, Artificial Sequence; identical to SEQ ID NO: 2939
  VP8* aa41-223P[6]-Variant SP(HLA-A2) w/o glyco mRNA opt Design2

SEQ ID NO: 3565 - RNA, 1057 nt, Artificial Sequence; identical to SEQ ID NO: 2943
  VP8* aa41-223P[6]-Variant SP(TPA)+P2+Linker w/o glyco mRNA opt Design2

SEQ ID NO: 3566 - RNA, 1048 nt, Artificial Sequence; identical to SEQ ID NO: 2947
  VP8* aa41-223P[6]-Variant SP(HSA)+P2+Linker w/o glyco mRNA opt Design2

SEQ ID NO: 3567 - RNA, 1048 nt, Artificial Sequence; identical to SEQ ID NO: 2951
  VP8* aa41-223P[6]-Variant SP(IgE)+P2+Linker w/o glyco mRNA opt Design2

SEQ ID NO: 3568 - RNA, 1066 nt, Artificial Sequence; identical to SEQ ID NO: 2955
  VP8* aa41-223P[6]-Variant SP(CD5)+P2+Linker w/o glyco mRNA opt Design2

SEQ ID NO: 3569 - RNA, 1066 nt, Artificial Sequence; identical to SEQ ID NO: 2959
  VP8* aa41-223 P[6]-Variant SP(HLA-A2)+P2+Linker w/o glyco mRNA opt Design2

SEQ ID NO: 3570 - RNA, 865 nt, Artificial Sequence; identical to SEQ ID NO: 3011
  VP8* aa65-223 short P[6]-Variant w/o glyco mRNA opt Design2

SEQ ID NO: 3571 - RNA, 925 nt, Artificial Sequence; identical to SEQ ID NO: 3015
  VP8* aa65-223 short P[6]-Variant P2+Linker w/o glyco mRNA opt Design2

SEQ ID NO: 3572 - RNA, 925 nt, Artificial Sequence; identical to SEQ ID NO: 3019
  VP8* aa65-223 short P[6]-Variant SP(TPA) w/o glyco mRNA opt Design2

SEQ ID NO: 3573 - RNA, 916 nt, Artificial Sequence; identical to SEQ ID NO: 3023
  VP8* aa65-223 short P[6]-Variant SP(HSA) w/o glyco mRNA opt Design2

SEQ ID NO: 3574 - RNA, 916 nt, Artificial Sequence; identical to SEQ ID NO: 3027
  VP8* aa65-223 short P[6]-Variant SP(IgE) w/o glyco mRNA opt Design2

SEQ ID NO: 3575 - RNA, 934 nt, Artificial Sequence; identical to SEQ ID NO: 3031
  VP8* aa65-223 short P[6]-Variant SP(CD5) w/o glyco mRNA opt Design2

SEQ ID NO: 3576 - RNA, 934 nt, Artificial Sequence; identical to SEQ ID NO: 3035
  VP8* aa65-223 short P[6]-Variant SP(HLA-A2) w/o glyco mRNA opt Design2

SEQ ID NO: 3577 - RNA, 985 nt, Artificial Sequence; identical to SEQ ID NO: 3039
  VP8* aa65-223 short P[6]-Variant SP(TPA)+P2+Linker w/o glyco mRNA opt Design2

SEQ ID NO: 3578 - RNA, 976 nt, Artificial Sequence; identical to SEQ ID NO: 3043
  VP8* aa65-223 short P[6]-Variant SP(HSA)+P2+Linker w/o glyco mRNA opt Design2

SEQ ID NO: 3579 - RNA, 976 nt, Artificial Sequence; identical to SEQ ID NO: 3047
  VP8* aa65-223 short P[6]-Variant SP(IgE)+P2+Linker w/o glyco mRNA opt Design2

SEQ ID NO: 3580 - RNA, 994 nt, Artificial Sequence; identical to SEQ ID NO: 3051
  VP8* aa65-223 short P[6]-Variant SP(CD5)+P2+Linker w/o glyco mRNA opt Design2

SEQ ID NO: 3581 - RNA, 994 nt, Artificial Sequence; identical to SEQ ID NO: 3055
  VP8* aa65-223 short P[6]-Variant SP(HLA-A2)+P2+Linker w/o glyco mRNA opt Design2

SEQ ID NO: 3582 - RNA, 865 nt, Artificial Sequence; identical to SEQ ID NO: 3011
  VP8* aa64-223 short P[6]-Variant w/o glyco mRNA opt Design2

SEQ ID NO: 3583 - RNA, 928 nt, Artificial Sequence; identical to SEQ ID NO: 3085
  VP8* aa64-223 short P[6]-Variant P2+Linker w/o glyco mRNA opt Design2

SEQ ID NO: 3584 - RNA, 928 nt, Artificial Sequence; identical to SEQ ID NO: 3087
  VP8* aa64-223 short P[6]-Variant SP(TPA) w/o glyco mRNA opt Design2

SEQ ID NO: 3585 - RNA, 919 nt, Artificial Sequence; identical to SEQ ID NO: 3089
  VP8* aa64-223 short P[6]-Variant SP(HSA) w/o glyco mRNA opt Design2

SEQ ID NO: 3586 - RNA, 919 nt, Artificial Sequence; identical to SEQ ID NO: 3091
  VP8* aa64-223 short P[6]-Variant SP(IgE) w/o glyco mRNA opt Design2

SEQ ID NO: 3587 - RNA, 937 nt, Artificial Sequence; identical to SEQ ID NO: 3093
  VP8* aa64-223 short P[6]-Variant SP(CD5) w/o glyco mRNA opt Design2

SEQ ID NO: 3588 - RNA, 937 nt, Artificial Sequence; identical to SEQ ID NO: 3095
  VP8* aa64-223 short P[6]-Variant SP(HLA-A2) w/o glyco mRNA opt Design2

SEQ ID NO: 3589 - RNA, 988 nt, Artificial Sequence; identical to SEQ ID NO: 3097
  VP8* aa64-223 short P[6]-Variant SP(TPA)+P2+Linker w/o glyco mRNA opt Design2

SEQ ID NO: 3590 - RNA, 979 nt, Artificial Sequence; identical to SEQ ID NO: 3099
  VP8* aa64-223 short P[6]-Variant SP(HSA)+P2+Linker w/o glyco mRNA opt Design2

SEQ ID NO: 3591 - RNA, 979 nt, Artificial Sequence; identical to SEQ ID NO: 3101
  VP8* aa64-223 short P[6]-Variant SP(IgE)+P2+Linker w/o glyco mRNA opt Design2

SEQ ID NO: 3592 - RNA, 997 nt, Artificial Sequence; identical to SEQ ID NO: 3103
  VP8* aa64-223 short P[6]-Variant SP(CD5)+P2+Linker w/o glyco mRNA opt Design2

SEQ ID NO: 3593 - RNA, 997 nt, Artificial Sequence; identical to SEQ ID NO: 3105
  VP8* aa64-223 short P[6]-Variant SP(HLA-A2)+P2+Linker w/o glyco mRNA opt Design2
